United States Patent 8,461,315 (MICRORNAS AND USES THEREOF) - sequence listing, part 26

SEQ ID NO: 758202 - RNA, 62 nt, Homo Sapiens
auuuauuguuaauucuuaaaauaguguguaaauaaaauaacaucagugugcuuuaaagaaau

SEQ ID NO: 758203 - RNA, 62 nt, Homo Sapiens
aaagauaauguacaugcuucaugucaugucuuuaaaauaauuuaaucaacuuuauugucuua

SEQ ID NO: 758204 - RNA, 62 nt, Homo Sapiens
uauauuaauauaguuuuuuucucccuuuuuaauaaaauaauuacagucaucccucagugucu

SEQ ID NO: 758205 - RNA, 62 nt, Homo Sapiens
acaaagcaagacugugucucaaaauaaauaaauaaaauaaaauaaaaugacguacagagauu

SEQ ID NO: 758206 - RNA, 62 nt, Homo Sapiens
gcaagacugugucucaaaauaaauaaauaaaauaaaauaaaaugacguacagagauucuaua

SEQ ID NO: 758207 - RNA, 62 nt, Homo Sapiens
auauuacauucaugauuauuuuauuuaguaaauaaaauaauagagagcccagaaaucaaccu

SEQ ID NO: 758208 - RNA, 62 nt, Homo Sapiens
ugaaacugaaccccuacuucuccccauauauguaaaauaauucaauauggaugaaagauuua

SEQ ID NO: 758209 - RNA, 62 nt, Homo Sapiens
uauuauauagguugaaauuaaagaugaauaaauaaaauaaaaugacacaaggccaaaaacaa

SEQ ID NO: 758210 - RNA, 62 nt, Homo Sapiens
uugugucuguugcacauuucuugaagcauuuuuaaaauaacauguaaccuguaaccuuguug

SEQ ID NO: 758211 - RNA, 62 nt, Homo Sapiens
uuuuacuuauagaaacuuaauuauuagacugguaaaauaaagaccaaaauaugcagauuucu

SEQ ID NO: 758212 - RNA, 62 nt, Homo Sapiens
cuauuuaugucacaucucacauuaaauuauuuuaaaauaagcagugcccuucaaaacagaug

SEQ ID NO: 758213 - RNA, 62 nt, Homo Sapiens
gguucuuucuaaacacuuguguauaggaauuauaaaauaauuuuuuugugguucuauuucag

SEQ ID NO: 758214 - RNA, 62 nt, Homo Sapiens
caguauuuacauguuaucuuuguacuguaggcuaaaauaacaaucauuuguauccagauuac

SEQ ID NO: 758215 - RNA, 62 nt, Homo Sapiens
gguuuacuugucugcagaaucuauuugugguuuaaaauaaaauaguuguggccaccugcuga

SEQ ID NO: 758216 - RNA, 62 nt, Homo Sapiens
aucaguuaaauauuggaagcaucauccucaaguaaaauaaaucaugcuuuuuggaaauuuac

SEQ ID NO: 758217 - RNA, 62 nt, Homo Sapiens
aauuagcagcccucugcauaccuuccauuuuuuaaaauaagauagucuccugcuguuuuacc

SEQ ID NO: 758218 - RNA, 62 nt, Homo Sapiens
uuagacagaagccaguauacuccauacacaaguaaaauaagaccugguuaugauacuguggg

SEQ ID NO: 758219 - RNA, 62 nt, Homo Sapiens
agcaguguucuccauucguauuaaucugcuuuuaaaauaaagcucaaguagaagccugaaaa

SEQ ID NO: 758220 - RNA, 62 nt, Homo Sapiens
aucauguuaaccucugcuuuuaucucagauguuaaaauaaaugguuuggugcuuuuuauaaa

SEQ ID NO: 758221 - RNA, 62 nt, Homo Sapiens
uugaaaagcaauauuguauauuuuuaucuauauaaaauaacuaaaauguaucuaagaauaau

SEQ ID NO: 758222 - RNA, 62 nt, Homo Sapiens
aauacagauuaccaauuucaagugcugccagcuaaaauaacuguuuuaacggguaucuuuug

SEQ ID NO: 758223 - RNA, 62 nt, Homo Sapiens
auguuuagcaggcuguaaacuuaagaaaaggguaaaauaaaauuuucuggagaggaacuugg

SEQ ID NO: 758224 - RNA, 62 nt, Homo Sapiens
aaaggagauuugacacuuaauucccauuuucuuaaaauaacaguuuuguugacuuaaaaaua

SEQ ID NO: 758225 - RNA, 62 nt, Homo Sapiens
cucauacaccaaaaacacaccaaaaaaaucaauaaaauaagcaaucuucuauucucauuccu

SEQ ID NO: 758226 - RNA, 62 nt, Homo Sapiens
uuauuuagauggacauugcuuuucaaauaacuuaaaauaacacguuaugugccauguggcua

SEQ ID NO: 758227 - RNA, 62 nt, Homo Sapiens
uaaaugcuauuuguagucuugauauacagaaauaaaauaauuaggguuggucuuuuuuauuu

SEQ ID NO: 758228 - RNA, 62 nt, Homo Sapiens
uacuuucucuaguuuuggagauuuuauaucaauaaaauaaaaaccuuuaaacccauaaauua

SEQ ID NO: 758229 - RNA, 62 nt, Homo Sapiens
ccaaucaaacacagaauuuguaaagcugaguauaaaauaaaauacaguuuugugauauaaaa

SEQ ID NO: 758230 - RNA, 62 nt, Homo Sapiens
cugaguauaaaauaaaaccaaguuuugugauauaaaauaaaguaaccuuauaccugaauuac

SEQ ID NO: 758231 - RNA, 62 nt, Homo Sapiens
uuaauaaaaacaaaccuugcgcuauuuuaaaauaaaauaagacagaauaacuucuagguuau

SEQ ID NO: 758232 - RNA, 62 nt, Homo Sapiens
uaagauuaauaaaaacaaacguuaugcuauuuuaaaauaaaauauaacagaauaacuucuag

SEQ ID NO: 758233 - RNA, 62 nt, Homo Sapiens
cuucacugcccuaucaaaauccucacauacuauaaaauaaauaacacacacacacacacacc

SEQ ID NO: 758234 - RNA, 62 nt, Homo Sapiens
ugacuauuaaccagaaaagaagagcguuugauuaaaauaaagauaagaaguccauauacuga

SEQ ID NO: 758235 - RNA, 62 nt, Homo Sapiens
ucgauucccagauuccauacuuacaagucagguaaaauaaaaacaauuuuaaauaauucauc

SEQ ID NO: 758236 - RNA, 62 nt, Homo Sapiens
cucuuuacaauaugcuggcucauucuguuggcuaaaauaauguaaaauucauaaagucucau

SEQ ID NO: 758237 - RNA, 62 nt, Homo Sapiens
aaaaagaaaaguauaguuaaucaaauuugccuuaaaauaaugccucaccacugacuauuuua

SEQ ID NO: 758238 - RNA, 62 nt, Homo Sapiens
uuucacacaauaaaaaacaaaaauauuauuaguaaaauaaaaaauuaguuaaaauauauuaa

SEQ ID NO: 758239 - RNA, 62 nt, Homo Sapiens
aguaugguuuauauguugaauuuucugcauuguaaaauaaucauauagaaaaaaaggaggau

SEQ ID NO: 758240 - RNA, 62 nt, Homo Sapiens
uuuacucugaaagaggaggaaaugcuggugacuaaaauaaggauuuaugugcuauggaagga

SEQ ID NO: 758241 - RNA, 62 nt, Homo Sapiens
gcuauaguggaaucuuugguuuugcaucauaguaaaauaaaauaaacccaucacauuuggaa

SEQ ID NO: 758242 - RNA, 62 nt, Homo Sapiens
aguggaaucuuugguuuugcaucauaguaaaauaaaauaaacccaucacauuuggaacauaa

SEQ ID NO: 758243 - RNA, 62 nt, Homo Sapiens
guauuucaaagcucuuuuccuaacugguuaaguaaaauaaaaaauugagcuuucuagaauau

SEQ ID NO: 758244 - RNA, 62 nt, Homo Sapiens
cuagaauauuugccuaauugggaauuaaaaaguaaaauaauaggccaggcaugguggcucau

SEQ ID NO: 758245 - RNA, 62 nt, Homo Sapiens
aaaugcauauaaaucuugauaaacaaagucuauaaaauaaaacaugggacauuagcuuuggg

SEQ ID NO: 758246 - RNA, 62 nt, Homo Sapiens
uuaaauucugauauugcacuucuuauuuuauauaaaauaauccuuuaauauccaaaugaauc

SEQ ID NO: 758247 - RNA, 62 nt, Homo Sapiens
auaguacuauugcuaguacuaaaauuuaccuuuaaaauaauauacuauuuuuauuuuaaaau

SEQ ID NO: 758248 - RNA, 62 nt, Homo Sapiens
uuuaccuuuaaaauaauaaucuauuuuuauuuuaaaauaaaauaauaguacuauuacuauua

SEQ ID NO: 758249 - RNA, 62 nt, Homo Sapiens
auguuauccaacuauuaagacacauauuguuuuaaaauaagaauugcaaaaucuccaaucca

SEQ ID NO: 758250 - RNA, 62 nt, Homo Sapiens
cuuuuucagaaaauauuuaaagagaacaauaauaaaauaauuauuguuugagguuuguugcu

SEQ ID NO: 758251 - RNA, 62 nt, Homo Sapiens
aggaguguuauugcaugcuguucagaacuauuuaaaauaaaguuuauaaaauguauaaauua

SEQ ID NO: 758252 - RNA, 62 nt, Homo Sapiens
auggauagguggugacccacaaauaaaauaaauaaaauaaaagguaaacaaagaaaugacaa

SEQ ID NO: 758253 - RNA, 62 nt, Homo Sapiens
aaaauaaaaauggauaggugaaaugacaaaaauaaaauaaauaaaaggauagguaaacaaag

SEQ ID NO: 758254 - RNA, 62 nt, Homo Sapiens
agaauaguuuauuaccuuuucaauauuugguauaaaauaacuguuguuuugacuaggaauau

SEQ ID NO: 758255 - RNA, 62 nt, Homo Sapiens
aauacauuuuugacagaggcaauccuguacccuaaaauaagaugaguaucaucuuguccuuu

SEQ ID NO: 758256 - RNA, 62 nt, Homo Sapiens
gagcuauguauuaacacugcuuucuccuuugauaaaauaaauauugcuuacuuuggaauaca

SEQ ID NO: 758257 - RNA, 62 nt, Homo Sapiens
auaaauucaccuagucuaagaaaaaaauaaaauaaaauaaaacaugaaaaaaggacaauuuc

SEQ ID NO: 758258 - RNA, 62 nt, Homo Sapiens
uaaaaauaaauucaccuaguauuucaaaaaaauaaaauaaaauuugacaugaaaaaaggaca

SEQ ID NO: 758259 - RNA, 62 nt, Homo Sapiens
ugcugccauucuugauugcuuguugauuguuauaaaauaacacaaauuuuaaaagccacagg

SEQ ID NO: 758260 - RNA, 62 nt, Homo Sapiens
acaccaaguuauaugacuaauuuagcacuauuuaaaauaagcuguugucuucacuuaaucca

SEQ ID NO: 758261 - RNA, 62 nt, Homo Sapiens
uuaucucuuucuuucuguuguauuugaaccaauaaaauaauuuaugucuauuuuuuucaguu

SEQ ID NO: 758262 - RNA, 62 nt, Homo Sapiens
auuuuuaagaaauaaauuuagacauaauccaguaaaauaauaaagaacacagcccugcuucu

SEQ ID NO: 758263 - RNA, 62 nt, Homo Sapiens
caagcacaaguacgaacuuacuauuuauaaaauaaaauaaacuggaaccaugcgagugauac

SEQ ID NO: 758264 - RNA, 62 nt, Homo Sapiens
uaaaccaagcacaaguacgagauaccuauuuauaaaauaaaagcauuuggaaccaugcgagu

SEQ ID NO: 758265 - RNA, 62 nt, Homo Sapiens
gaaauuauuacaaacggucuccucaguaaaaguaaaauaacaauaguuggaaguaaagcacu

SEQ ID NO: 758266 - RNA, 62 nt, Homo Sapiens
gcaaauaaagcaaugauuaucucacuugcaaauaaaauaaguaacuugcgaaucuguuuacc

SEQ ID NO: 758267 - RNA, 62 nt, Homo Sapiens
cacaauugcuauaugaaacuuaaagcauaauauaaaauaagggcuguagucauacaauugga

SEQ ID NO: 758268 - RNA, 62 nt, Homo Sapiens
uaaaacugcuuacaccagaaauuggcaaaaacuaaaauaaaucacuuuucuaaggacugaag

SEQ ID NO: 758269 - RNA, 62 nt, Homo Sapiens
cugagagagaauugguccauucaaagacuugauaaaauaacaauaaaacuguuauggugucu

SEQ ID NO: 758270 - RNA, 62 nt, Homo Sapiens
cauuuaauaaaauaguacuuguucauauuguguaaaauaacuacaauuguaauuauauugau

SEQ ID NO: 758271 - RNA, 62 nt, Homo Sapiens
aaaaaagaaagcaugauauuacaaaaacaaaauaaaauaauaacuauuuccaaacucauauu

SEQ ID NO: 758272 - RNA, 62 nt, Homo Sapiens
auaaauaucauuguacauaggucuauaaaaaauaaaauaauuuauaaaagaaacacuuugaa

SEQ ID NO: 758273 - RNA, 62 nt, Homo Sapiens
uacaugcauuuaauauuuccucaucaaguucuuaaaauaauauuaaaagaauguaaaauaua

SEQ ID NO: 758274 - RNA, 62 nt, Homo Sapiens
aauauguaaaagugagguagacauuauggcuuuaaaauaaugucuuuauggauguauuguuc

SEQ ID NO: 758275 - RNA, 62 nt, Homo Sapiens
uuauugcaauacauacaaaaaauugucaaauauaaaauaaugggccaauauaaacauguuug

SEQ ID NO: 758276 - RNA, 62 nt, Homo Sapiens
ucuuaaaaaauuuauacuuaccuuuuuuaaaauaaaauaagugccaaaauaaaccuguucuu

SEQ ID NO: 758277 - RNA, 62 nt, Homo Sapiens
uaaguucuuaaaaaauuuauuucuuccuuuuuuaaaauaaaauuucugccaaaauaaaccug

SEQ ID NO: 758278 - RNA, 62 nt, Homo Sapiens
ggugacagagugagacucugucucaaaaaaaauaaaauaaaaagucaauuuagaaugugaaa

SEQ ID NO: 758279 - RNA, 62 nt, Homo Sapiens
gaugguuguauaagaacuagcucauguaaaaauaaaauaacauuauuacauugccucaaaaa

SEQ ID NO: 758280 - RNA, 62 nt, Homo Sapiens
gucauuuaccaggauucccguagggcguuuuguaaaauaaacuauaauauuaaugaaaagua

SEQ ID NO: 758281 - RNA, 62 nt, Homo Sapiens
acuguaaauacauuuguaccucucuuguauucuaaaauaaaaauuacuuggaacauuuauca

SEQ ID NO: 758282 - RNA, 62 nt, Homo Sapiens
aaauauaaugaucuguguuuaggaagugaaccuaaaauaagauuuuacuaguagcuaguguu

SEQ ID NO: 758283 - RNA, 62 nt, Homo Sapiens
uuuccuuuuaaaugugcugcucaaauccaauuuaaaauaaccguauagguaaauuuucuuuu

SEQ ID NO: 758284 - RNA, 62 nt, Homo Sapiens
uauaaauucauauauuaaaaauauuaaauuuauaaaauaauuacuuuaaaauuuuuuaaauu

SEQ ID NO: 758285 - RNA, 62 nt, Homo Sapiens
uauaaucagcaacaacacaaugaacacaaauuuaaaauaagcuggguagauuuucaagagug

SEQ ID NO: 758286 - RNA, 62 nt, Homo Sapiens
uuccucucacuuguaccccagaguaaaguuucuaaaauaacaaugaugacucaguggugcca

SEQ ID NO: 758287 - RNA, 62 nt, Homo Sapiens
guuauucucugauaaagagcaaacuuuccaaauaaaauaaauagauagucucauauuuagga

SEQ ID NO: 758288 - RNA, 62 nt, Homo Sapiens
ucuaauccuacuaccuagaaaaauaagaaaauuaaaauaaucacugaccaaaacagaagcaa

SEQ ID NO: 758289 - RNA, 62 nt, Homo Sapiens
aaauucuuagauuaaaucaguuuuauuaugcauaaaauaaagcagcuguucuuuguaguccc

SEQ ID NO: 758290 - RNA, 62 nt, Homo Sapiens
cucugauuucaguucacuguucaguuuagcauuaaaauaauaaaauaaucauacaguuccau

SEQ ID NO: 758291 - RNA, 62 nt, Homo Sapiens
ucaguucacuguucaguuuagcauuaaaauaauaaaauaaucauacaguuccauuugauugu

SEQ ID NO: 758292 - RNA, 62 nt, Homo Sapiens
acaaaaaugaaaauaauaaacauguuuucguauaaaauaacacaaaaugauauacacugaag

SEQ ID NO: 758293 - RNA, 62 nt, Homo Sapiens
guaaccagaaauguaaaauuucaaauaacggauaaaauaauguguuauuuuuauagagaaag

SEQ ID NO: 758294 - RNA, 62 nt, Homo Sapiens
aauguuuucucucuuaaaauauuucuccuguguaaaauaaaucauuguuguuaguaaugguu

SEQ ID NO: 758295 - RNA, 62 nt, Homo Sapiens
ggcucucuaaagaaaaacucauuguaacuuauuaaaauaauaucuggugcaaaguaucuguu

SEQ ID NO: 758296 - RNA, 62 nt, Homo Sapiens
uaaucaugugaacauuugaacuaguuauaggauaaaauaaacucagaauaaggauuuaaaau

SEQ ID NO: 758297 - RNA, 62 nt, Homo Sapiens
uuauaggauaaaauaaacucagaauaaggauuuaaaauaaguaaccaaguggcugugacuuu

SEQ ID NO: 758298 - RNA, 62 nt, Homo Sapiens
cacuggauuaauaaucuuuugggaggguagaauaaaauaauugauuacuauugcugcauacc

SEQ ID NO: 758299 - RNA, 62 nt, Homo Sapiens
auggaauuagaugagugcuaugcacuuaauuuuaaaauaaaacuaguuuucaguaaaauggc

SEQ ID NO: 758300 - RNA, 62 nt, Homo Sapiens
auaauaauaauauuaauaauaauaaagagaaauaaaauaauaaaauaaaaaacaauagcaca

SEQ ID NO: 758301 - RNA, 62 nt, Homo Sapiens
aauauuaauaauaauaaagagaaauaaaauaauaaaauaaaaaacaauagcacagcccuugu

SEQ ID NO: 758302 - RNA, 62 nt, Homo Sapiens
gggaaagaaggugggucaugagaauuuuaaaauaaaauaauuuaccuggcacuagcaacauu

SEQ ID NO: 758303 - RNA, 62 nt, Homo Sapiens
uaauugggaaagaaggugggacauuagaauuuuaaaauaaaauccauuaccuggcacuagca

SEQ ID NO: 758304 - RNA, 62 nt, Homo Sapiens
uuuagauuuaagucgagcuccauaaaauaaaauaaaauaaaauuuauuagagggagcauggc

SEQ ID NO: 758305 - RNA, 62 nt, Homo Sapiens
uaaaauuuagauuuaagucgauggccauaaaauaaaauaaaauuagauuuauuagagggagc

SEQ ID NO: 758306 - RNA, 62 nt, Homo Sapiens
uaaaauaaaauuuagauuuaggagcauggccauaaaauaaaaaaaauuuagauuuauuagag

SEQ ID NO: 758307 - RNA, 62 nt, Homo Sapiens
uauuuacuguguauugccugcuaugcuauuauuaaaauaaaacaauuuucuucagaagaauu

SEQ ID NO: 758308 - RNA, 62 nt, Homo Sapiens
gcuauaauguauaacaauuuucucuguuacuguaaaauaauaguaucucuaauuuuauuuuc

SEQ ID NO: 758309 - RNA, 62 nt, Homo Sapiens
ggcuguuauuucuacuguguaaaacugauacuuaaaauaaauucaaaaugcacuuuuuaaua

SEQ ID NO: 758310 - RNA, 62 nt, Homo Sapiens
uauuccuugaaaauauaaauaauguuuuuauuuaaaauaaagauggucaguaggcaaucuua

SEQ ID NO: 758311 - RNA, 62 nt, Homo Sapiens
accucccuaauccuauuaucgagaagaugccauaaaauaaacaagugcuaagaacuccauga

SEQ ID NO: 758312 - RNA, 62 nt, Homo Sapiens
uauuguauuaaaaauuuaaaagauguuuauauuaaaauaaaauaucuuugucuauaacugac

SEQ ID NO: 758313 - RNA, 62 nt, Homo Sapiens
uagauuguguugcuauuuuucucucaguacccuaaaauaaacuguccuuuaagucugcuagg

SEQ ID NO: 758314 - RNA, 62 nt, Homo Sapiens
uuagugcaauaugaagacguaguucuuccauguaaaauaauugguauuaugaugcaucaacu

SEQ ID NO: 758315 - RNA, 62 nt, Homo Sapiens
aggguugguuauauugcaauguuuauuauuauuaaaauaaacguuuuuaaaagacugacagu

SEQ ID NO: 758316 - RNA, 62 nt, Homo Sapiens
gauuuuauaaaauaccuuccgauugccacucauaaaauaaagguguuggguagggaggugac

SEQ ID NO: 758317 - RNA, 62 nt, Homo Sapiens
ccaagcugagucuucuagauaacauaaaaucuuaaaauaauuuuuuccauaauauugcaaau

SEQ ID NO: 758318 - RNA, 62 nt, Homo Sapiens
ccuauuuuuccuguuauuguaggggaaaaagauaaaauaaccgguaguucuuguuuuuaaua

SEQ ID NO: 758319 - RNA, 62 nt, Homo Sapiens
uuuaaaaguagagugacuguuuuaugacuauuuaaaauaaaauauuaagagaaaaaaaguaa

SEQ ID NO: 758320 - RNA, 62 nt, Homo Sapiens
ucaauaaagacaauucugacauguacaaaaacuaaaauaaaguaugaacaugauuuuucuuu

SEQ ID NO: 758321 - RNA, 62 nt, Homo Sapiens
cauauagcuacuuucaguuguaaaaugaacaauaaaauaaaguaaaagcuuuggaaacucug

SEQ ID NO: 758322 - RNA, 62 nt, Homo Sapiens
aguauaacugugcaauucuggaacauauuaauuaaaauaauaugccuuaacauauagugaau

SEQ ID NO: 758323 - RNA, 62 nt, Homo Sapiens
ugaccuugaaagaugaauuccuucaagaaaaauaaaauaaugcuuaagauaauguguacgaa

SEQ ID NO: 758324 - RNA, 62 nt, Homo Sapiens
uuggcaguacguucuuugacuuaaggauggcauaaaauaaucauuuuugaaccuguguaaua

SEQ ID NO: 758325 - RNA, 62 nt, Homo Sapiens
cuacagagagcaagacucugucucaaaaaaaauaaaauaaaauaaauaaaaaaagauauagu

SEQ ID NO: 758326 - RNA, 62 nt, Homo Sapiens
gagagcaagacucugucucaaaaaaaauaaaauaaaauaaauaaaaaaagauauaguauuaa

SEQ ID NO: 758327 - RNA, 62 nt, Homo Sapiens
ggugggaaaugggggaucuucaauguuuauuuuaaaauaaaauaaaauaaguucuugacuuu

SEQ ID NO: 758328 - RNA, 62 nt, Homo Sapiens
gaaaugggggaucuucaauguuuauuuuaaaauaaaauaaaauaaguucuugacuuuucuca

SEQ ID NO: 758329 - RNA, 62 nt, Homo Sapiens
gggggaucuucaauguuuauuuuaaaauaaaauaaaauaaguucuugacuuuucucaugugu

SEQ ID NO: 758330 - RNA, 62 nt, Homo Sapiens
gucuuugaauucauuuauuuuaaauaaaugaauaaaauaaaauaaaaaagaauauucagucg

SEQ ID NO: 758331 - RNA, 62 nt, Homo Sapiens
ugaauucauuuauuuuaaauaaaugaauaaaauaaaauaaaaaagaauauucagucguuggc

SEQ ID NO: 758332 - RNA, 62 nt, Homo Sapiens
agaaaaaauucugugaauuaagauguaauuuauaaaauaacauuucaauggggguaaacagg

SEQ ID NO: 758333 - RNA, 62 nt, Homo Sapiens
gagcaagacuccgucucacaaaaaugaauaaauaaaauaaaaauaaaaauguuacuuuuuaa

SEQ ID NO: 758334 - RNA, 62 nt, Homo Sapiens
augggacaaccacaaggucuggaaacuagguuuaaaauaagugugcacuuggacauaaagac

SEQ ID NO: 758335 - RNA, 62 nt, Homo Sapiens
auguaacaagccugcacauguaccccagaaucuaaaauaaaaauaaaaagaaaaacaaagaa

SEQ ID NO: 758336 - RNA, 62 nt, Homo Sapiens
uuuuucaauagauuacuucaccagaauggauguaaaauaacauuuaaaauuugugguaauac

SEQ ID NO: 758337 - RNA, 62 nt, Homo Sapiens
ggcaaaugcuaugcuucuacgacucgguuuuuuaaaauaacucuuugagacuaauuuguauu

SEQ ID NO: 758338 - RNA, 62 nt, Homo Sapiens
guagcucaaaggagccaaguauuuauaauucuuaaaauaaggcuuuguguggguugacaccu

SEQ ID NO: 758339 - RNA, 62 nt, Homo Sapiens
aaaaauuuauuuaucacaguuuaaaauaauaauaaaauaauugucugaacuuauuuguuuau

SEQ ID NO: 758340 - RNA, 62 nt, Homo Sapiens
auaaaauaauuaaaaauuuauauuuguuuauuuaaaauaauacauaaauaacagucugaacu

SEQ ID NO: 758341 - RNA, 62 nt, Homo Sapiens
auguauggauuacuuuuuuuuguaaacaugguuaaaauaaaacuuuugugguucuucugaau

SEQ ID NO: 758342 - RNA, 62 nt, Homo Sapiens
uagcaguggcuuauuauuuguuuuucauaaauuaaaauaacuuuugauaauguuuacuuuaa

SEQ ID NO: 758343 - RNA, 62 nt, Homo Sapiens
ggacacauucuuuauaaagagauuuaaaauaauaaaauaaaucaucauuuuaugaaaguuca

SEQ ID NO: 758344 - RNA, 62 nt, Homo Sapiens
aaauaaauggacacauucuuaaaguucagauuuaaaauaauacagauaaccaucauuuuaug

SEQ ID NO: 758345 - RNA, 62 nt, Homo Sapiens
auucugaauguacacgacaugguucuuuguuuuaaaauaaaaggauuuucuauuguuacucu

SEQ ID NO: 758346 - RNA, 62 nt, Homo Sapiens
gguucuugguagagauucauaaauaagaaaccuaaaauaauuaucucgugggagagccaucc

SEQ ID NO: 758347 - RNA, 62 nt, Homo Sapiens
aaucaguaugauggaauaaauuuauaugaaguuaaaauaaaaauaaaauaauauaaaaguga

SEQ ID NO: 758348 - RNA, 62 nt, Homo Sapiens
uaaaagugauuuauaugaaguaaaauaccaaauaaaauaauaaauuuuggaagcugugaaga

SEQ ID NO: 758349 - RNA, 62 nt, Homo Sapiens
gaagugagauggcauggugauguuacuuauuuuaaaauaaauuccuuuugauaaauuuaaaa

SEQ ID NO: 758350 - RNA, 62 nt, Homo Sapiens
auaaaaacaauccuuuugauuuaauaaugcuuuaaaauaaaauuuucaagucugauccauau

SEQ ID NO: 758351 - RNA, 62 nt, Homo Sapiens
acaugcuuaauccugaguaguuuuaacugaacuaaaauaaauaaugaaacaauguauguuug

SEQ ID NO: 758352 - RNA, 62 nt, Homo Sapiens
gggggccaucuagaaauagauuucuaugaagauaaaauaauucguugguccauuuuugucug

SEQ ID NO: 758353 - RNA, 62 nt, Homo Sapiens
aauuuugagguaccaaauaguucugugggaaauaaaauaacuauggaagauaaugcagauau

SEQ ID NO: 758354 - RNA, 62 nt, Homo Sapiens
ucauugguauuuaaaaaugacaauaaauuccauaaaauaaugcuuuauucagaagcaguuau

SEQ ID NO: 758355 - RNA, 62 nt, Homo Sapiens
guacuuucauuuuauaacaauguuuguaaaaauaaaauaaugaacuagucuugaaaugccuu

SEQ ID NO: 758356 - RNA, 62 nt, Homo Sapiens
ccauucagauugaaauucuaugaaauuggcuuuaaaauaaaaucuuugaaacaauauuauuu

SEQ ID NO: 758357 - RNA, 62 nt, Homo Sapiens
agugugccugauuauuuuuguugauuaagauguaaaauaaaauuccuuuuguauuuguaaug

SEQ ID NO: 758358 - RNA, 62 nt, Homo Sapiens
gagcugaacucaccugaaguaaaaaauaauaauaaaauaagucaagacucugucucaaaaaa

SEQ ID NO: 758359 - RNA, 62 nt, Homo Sapiens
cgagaaacuaugggaaaaaaaauugcaaaaucuaaaauaaaaaaugcaaaaucuaaaauaaa

SEQ ID NO: 758360 - RNA, 62 nt, Homo Sapiens
auugcaaaaucuaaaauaaaaaaugcaaaaucuaaaauaaaaaauggaaaggaaacuuugaa

SEQ ID NO: 758361 - RNA, 62 nt, Homo Sapiens
accucuuuaauggaagcugcaauuaauauuaguaaaauaaacuaauuucuuuuuuuaaagga

SEQ ID NO: 758362 - RNA, 62 nt, Homo Sapiens
aaauaaguaguuucauuacguuuauuaacuuuuaaaauaaaguaaaaauugagagguuuccu

SEQ ID NO: 758363 - RNA, 62 nt, Homo Sapiens
aaaaauagauuauuacgucugucucuuugauuuaaaauaaauguuuguuaggaaauggaaug

SEQ ID NO: 758364 - RNA, 62 nt, Homo Sapiens
cugauaguacauguguuguuuauuuuugcagguaaaauaaaguuuuccaaguguagcuaaaa

SEQ ID NO: 758365 - RNA, 62 nt, Homo Sapiens
uaggacaugagacugguagaagcuggcugagauaaaauaaguauuuauuuaaacuaauguuc

SEQ ID NO: 758366 - RNA, 62 nt, Homo Sapiens
gugcgaccaaugagacgacuucagcaucuuuuuaaaauaaucuaagcaucauugaagcagua

SEQ ID NO: 758367 - RNA, 62 nt, Homo Sapiens
aauucauacaacaucagugguuacagcuauacuaaaauaaaacuuuauaugcuaauuaucuu

SEQ ID NO: 758368 - RNA, 62 nt, Homo Sapiens
cuuuauaugcuaauuaucuucaagggucuuucuaaaauaaaagggguuguuaggcuacugca

SEQ ID NO: 758369 - RNA, 62 nt, Homo Sapiens
guaaugcaaauuucauaguaauaguaacuuuauaaaauaauauuauaaaauacaggauuuaa

SEQ ID NO: 758370 - RNA, 62 nt, Homo Sapiens
uauuaaauacuuugugauuuccuauuaagcuuuaaaauaaaucauuguguaaaacaccauca

SEQ ID NO: 758371 - RNA, 62 nt, Homo Sapiens
gggaggcugacucaaaacuagauagaaaaauauaaaauaaucuucgaccacuugauagcucu

SEQ ID NO: 758372 - RNA, 62 nt, Homo Sapiens
uacucuuagucucuaaaguugcaguuagaaacuaaaauaauguuuuuuaauauguaauaugc

SEQ ID NO: 758373 - RNA, 62 nt, Homo Sapiens
uauauauauaauauauacauauauacauaguguaaaauaaaauguuucuuggacaagaaauc

SEQ ID NO: 758374 - RNA, 62 nt, Homo Sapiens
ugcccuuuuuacccguugacguuuauuuuacguaaaauaaacuguuguuuccaaugcaauca

SEQ ID NO: 758375 - RNA, 62 nt, Homo Sapiens
gccaaauugaagauuaaagacuaaauguauuuuaaaauaaaauguccuaugacaguucuaug

SEQ ID NO: 758376 - RNA, 62 nt, Homo Sapiens
uaccuaaguguuuuuuuaaaauauauuauauauaaaauaauauaugcaauuauauaucugau

SEQ ID NO: 758377 - RNA, 62 nt, Homo Sapiens
aaagugauaagugauccuuaaaaccagccuucuaaaauaauugcauuccauggguuggguau

SEQ ID NO: 758378 - RNA, 62 nt, Homo Sapiens
ugugcuuaauguaaagccgcuuuauaaaacuguaaaauaaaguuuuuuucuuaaaaagaaua

SEQ ID NO: 758379 - RNA, 62 nt, Homo Sapiens
uguuccuugauaaaaggcuucauuuuauguauuaaaauaaacguuuacugcucguaaggaaa

SEQ ID NO: 758380 - RNA, 62 nt, Homo Sapiens
agcauucaaauuguaugcuucacuuuucauguuaaaauaauccaguuuguuuuucuuguaau

SEQ ID NO: 758381 - RNA, 62 nt, Homo Sapiens
ccauuuaaaaaguaaugcugauuauuuguacauaaaauaaaauauggguacaacguauguuc

SEQ ID NO: 758382 - RNA, 62 nt, Homo Sapiens
uauucuuugcaguaaaauaugcuagugauguauaaaauaaaaacuaauggcaaaaauucaug

SEQ ID NO: 758383 - RNA, 62 nt, Homo Sapiens
ucaguuccugagucacacaaaaugaaauaaaauaaaauaaaacgcuauuuaaguuaaauuua

SEQ ID NO: 758384 - RNA, 62 nt, Homo Sapiens
uaaaaucaguuccugagucaauuuaaaugaaauaaaauaaaaagugucgcuauuuaaguuaa

SEQ ID NO: 758385 - RNA, 62 nt, Homo Sapiens
cuuagagcaaaguuuaaaaccucaaaauaaaauaaaauaaaagggcaauagcaagacuccau

SEQ ID NO: 758386 - RNA, 62 nt, Homo Sapiens
uaaaacuuagagcaaaguuuuccaucucaaaauaaaauaaaaagcuugggcaauagcaagac

SEQ ID NO: 758387 - RNA, 62 nt, Homo Sapiens
uaaguggacauguuuauaguuauagauagcaauaaaauaacauacaguaaacugaaagagua

SEQ ID NO: 758388 - RNA, 62 nt, Homo Sapiens
uuauuuucauaaaugguuuguuuuaugccuuuuaaaauaaauuuucuuuuuacacuaauaac

SEQ ID NO: 758389 - RNA, 62 nt, Homo Sapiens
uauauuuuguucuauugguaugcugguauaauuaaaauaaaaggucuuucugggccuuacug

SEQ ID NO: 758390 - RNA, 62 nt, Homo Sapiens
agcuuaauucagauaucaguaaaauuaagucauaaaauaaucaugugucaugugacuuuggc

SEQ ID NO: 758391 - RNA, 62 nt, Homo Sapiens
agaccuuuaccaguaaauuauguuucuguauguaaaauaaccccuuauuagagagacagugu

SEQ ID NO: 758392 - RNA, 62 nt, Homo Sapiens
cucuauaacugcagaaauuagauaauguuuuauaaaauaaauuugccacauaauaugggaug

SEQ ID NO: 758393 - RNA, 62 nt, Homo Sapiens
cucuuuuguaaauuacaguuauuucaguauuguaaaauaaauguugacucauuucaugcagg

SEQ ID NO: 758394 - RNA, 62 nt, Homo Sapiens
ccaauuuuuaaaaagagaauaaaaaaauaaaauaaaauaaaacaacauagugagauucuguu

SEQ ID NO: 758395 - RNA, 62 nt, Homo Sapiens
uaaaaccaauuuuuaaaaagcuguuaaaaaaauaaaauaaaacugggcaacauagugagauu

SEQ ID NO: 758396 - RNA, 62 nt, Homo Sapiens
aaguugcuugagccaagugcuuaaaaaguuaauaaaauaaaaugaucuguaugauaccugca

SEQ ID NO: 758397 - RNA, 62 nt, Homo Sapiens
aaaacuuuguguuuuggcaaucguuuuauaacuaaaauaaaaugaaagcuaaaucuacacgc

SEQ ID NO: 758398 - RNA, 62 nt, Homo Sapiens
aaaccacuggaaaacaugcauuuuggaaacuuuaaaauaaaugguuaacauggcauuucuaa

SEQ ID NO: 758399 - RNA, 62 nt, Homo Sapiens
auaguaaggucaagaagaguaucaaaguauaauaaaauaaaaauuguauacucuccauauau

SEQ ID NO: 758400 - RNA, 62 nt, Homo Sapiens
cugacaaaguguuucuaggguguauauuaagguaaaauaaaauuuauuauugccuguacaaa

SEQ ID NO: 758401 - RNA, 62 nt, Homo Sapiens
ugaacucuuugacaaauugcaauccuuuuacauaaaauaaucaauuuuaauccuuuuauuuu

SEQ ID NO: 758402 - RNA, 62 nt, Homo Sapiens
uauuguaucaguccagguucuauauauauauauaaaauaacuuuuuuuuuauacauaauaua

SEQ ID NO: 758403 - RNA, 62 nt, Homo Sapiens
uuuugugugugugugcagaauguauagcaugcuaaaauaaauuccuguugcacugcagcuug

SEQ ID NO: 758404 - RNA, 62 nt, Homo Sapiens
agaagaaaauggccaguauuuccacuuucuucuaaaauaaagaugugguagugagcugauca

SEQ ID NO: 758405 - RNA, 62 nt, Homo Sapiens
uacucuuaucacagcuguguauuauuucauaguaaaauaaucuaugcuuucaucuauucaga

SEQ ID NO: 758406 - RNA, 62 nt, Homo Sapiens
cgcuuuguuuuuuaaauaugguuugauacuauuaaaauaagcauucaauaccauacugaaga

SEQ ID NO: 758407 - RNA, 62 nt, Homo Sapiens
uuauaaaugaucuuuuguacuaguacuuaguguaaaauaauuuaguaaaaaaauaaaauaaa

SEQ ID NO: 758408 - RNA, 62 nt, Homo Sapiens
aguacuuaguguaaaauaauauaguaaaaaaauaaaauaaauguucuaggggguugaacuac

SEQ ID NO: 758409 - RNA, 62 nt, Homo Sapiens
acuacuguuuuuauuaaaacgaaugugcuuuuuaaaauaaugauauaaauaugcaccuagga

SEQ ID NO: 758410 - RNA, 62 nt, Homo Sapiens
cauguuaacaguuggucuguuuaccaguugacuaaaauaauguuauacuuaugaaauaaacu

SEQ ID NO: 758411 - RNA, 62 nt, Homo Sapiens
aaaaauuggaugcguaaaguaacuuggcugcuuaaaauaagcaguuacuuugcuuuuaaaga

SEQ ID NO: 758412 - RNA, 62 nt, Homo Sapiens
gaagaaauagaaauuuugaaccagagaaauuuuaaaauaauauuuuaaucaguuugcuuucu

SEQ ID NO: 758413 - RNA, 62 nt, Homo Sapiens
ccuguuaaacuuucugacaauuuaacaggaguuaaaauaacuuuuuuacugucaucuauuau

SEQ ID NO: 758414 - RNA, 62 nt, Homo Sapiens
aguuuuuaauuguaggcucauaggaaaacauuuaaaauaaauugguauuucugucuuauaca

SEQ ID NO: 758415 - RNA, 62 nt, Homo Sapiens
uauaaucugaaaaccucaugaacgcccaggauuaaaauaaaacuauguaaaaauaaaauuca

SEQ ID NO: 758416 - RNA, 62 nt, Homo Sapiens
uaaucaaagaauauuauuaaaaaauguuguaauaaaauaaucggaaaugacugguaauggaa

SEQ ID NO: 758417 - RNA, 62 nt, Homo Sapiens
auaauguaugaagcucuguuuaaaaaauaaaauaaaauaauacacuuuugcauuaauuuggu

SEQ ID NO: 758418 - RNA, 62 nt, Homo Sapiens
uaauaauaauguaugaagcuuugguuaaaaaauaaaauaaaaugaagcacuuuugcauuaau

SEQ ID NO: 758419 - RNA, 62 nt, Homo Sapiens
aaauaagacagcacuuuauaaauaagauaaaauaaaauaaacgagcaaaauuucaucucaaa

SEQ ID NO: 758420 - RNA, 62 nt, Homo Sapiens
uaaacaaauaagacagcacuucaaaaauaagauaaaauaaaaaacaagagcaaaauuucauc

SEQ ID NO: 758421 - RNA, 62 nt, Homo Sapiens
uacuuguaauuuuaaauuucagcuucacgauauaaaauaauauaagaacuucugguuuacaa

SEQ ID NO: 758422 - RNA, 62 nt, Homo Sapiens
ugauuuuuuaaaagcuguuauguugaauucaguaaaauaacauuaccuuauuuuuuuucuua

SEQ ID NO: 758423 - RNA, 62 nt, Homo Sapiens
cagccaacauugugagacauaaucucuacaaauaaaauaaauuaguuggacaugauggugug

SEQ ID NO: 758424 - RNA, 62 nt, Homo Sapiens
gagugacagagugagacuuugcaaccaaaaaauaaaauaauaauaauaaugaaauaaauaac

SEQ ID NO: 758425 - RNA, 62 nt, Homo Sapiens
guuguauuuaacagaaauuguauauuguaauuuaaaauaauuauauaacuguauuugaaaua

SEQ ID NO: 758426 - RNA, 62 nt, Homo Sapiens
uccuuccugugcuccacguucuucugugugauuaaaauaagaauauuauuuuuggaaauaug

SEQ ID NO: 758427 - RNA, 62 nt, Homo Sapiens
aacuucagaaucuaaugauaguuuaggguuucuaaaauaagguuuuuuauuguaaaaauuga

SEQ ID NO: 758428 - RNA, 62 nt, Homo Sapiens
uguggaacauguaaauacugucaaauggaaaauaaaauaaguuauaauuuuugugaauuuca

SEQ ID NO: 758429 - RNA, 62 nt, Homo Sapiens
gauguaaauguuuuacuuucaacuguguucuuuaaaauaaauccuaccugguuuuuaaauuu

SEQ ID NO: 758430 - RNA, 62 nt, Homo Sapiens
gaauucagugcucuuucauuacuguaaaucuuuaaaauaacauuugggaaccaaaguauuuu

SEQ ID NO: 758431 - RNA, 62 nt, Homo Sapiens
aaagauauguuaauuacuuuaauguuaagaaguaaaauaaugccacucauguaacuauuuua

SEQ ID NO: 758432 - RNA, 62 nt, Homo Sapiens
agugacugauuuuaauaaugagauaggucacuuaaaauaacagugccuuugaccuuaaaaca

SEQ ID NO: 758433 - RNA, 62 nt, Homo Sapiens
agucauuauagcucagaccuaagcuaauuauuuaaaauaaauacauguaaaggccacugcca

SEQ ID NO: 758434 - RNA, 62 nt, Homo Sapiens
ucuugaggucauauacugaaauaugaauaaauuaaaauaaugaauucagaucuaaucauuuu

SEQ ID NO: 758435 - RNA, 62 nt, Homo Sapiens
ugggagaggaaaugucagggcaugugcucugauaaaauaaaggcagggaaacaagcugaauu

SEQ ID NO: 758436 - RNA, 62 nt, Homo Sapiens
ugcugcaugacccuccaaguagaccuguggcuuaaaauaaagaaaaugcagcaaaaagaaug

SEQ ID NO: 758437 - RNA, 62 nt, Homo Sapiens
uguacacauugauauuuaaugacaaauuuacuuaaaauaaauugaccccuuguucuuacuug

SEQ ID NO: 758438 - RNA, 62 nt, Homo Sapiens
uaaccuauuaucauggaucugggcucugcaaauaaaauaauguuguucaaaucacugcagua

SEQ ID NO: 758439 - RNA, 62 nt, Homo Sapiens
caaaaccaaaacuauacuuucaugcuucuaaauaaaauaaaacccagcuuuagucauuugaa

SEQ ID NO: 758440 - RNA, 62 nt, Homo Sapiens
augucuucuugaaauuugugaaagcuuugaaauaaaauaacaucaggaggaugcaauuguug

SEQ ID NO: 758441 - RNA, 62 nt, Homo Sapiens
cucucaguuguuuauuauccgccucauacguuuaaaauaaaaauguuaacauuucagguuaa

SEQ ID NO: 758442 - RNA, 64 nt, Homo Sapiens; identical to SEQ ID NO: 52330

SEQ ID NO: 758443 - RNA, 64 nt, Homo Sapiens; identical to SEQ ID NO: 52331

SEQ ID NO: 758444 - RNA, 64 nt, Homo Sapiens; identical to SEQ ID NO: 52332

SEQ ID NO: 758445 - RNA, 64 nt, Homo Sapiens; identical to SEQ ID NO: 52333

SEQ ID NO: 758446 - RNA, 64 nt, Homo Sapiens; identical to SEQ ID NO: 52334

SEQ ID NO: 758447 - RNA, 64 nt, Homo Sapiens; identical to SEQ ID NO: 52335

SEQ ID NO: 758448 - RNA, 64 nt, Homo Sapiens; identical to SEQ ID NO: 52336

SEQ ID NO: 758449 - RNA, 63 nt, Homo Sapiens; identical to SEQ ID NO: 52337

SEQ ID NO: 758450 - RNA, 64 nt, Homo Sapiens; identical to SEQ ID NO: 52338

SEQ ID NO: 758451 - RNA, 64 nt, Homo Sapiens; identical to SEQ ID NO: 52339

SEQ ID NO: 758452 - RNA, 64 nt, Homo Sapiens; identical to SEQ ID NO: 52340

SEQ ID NO: 758453 - RNA, 64 nt, Homo Sapiens; identical to SEQ ID NO: 52341

SEQ ID NO: 758454 - RNA, 64 nt, Homo Sapiens; identical to SEQ ID NO: 52342

SEQ ID NO: 758455 - RNA, 64 nt, Homo Sapiens; identical to SEQ ID NO: 52343

SEQ ID NO: 758456 - RNA, 64 nt, Homo Sapiens; identical to SEQ ID NO: 52344

SEQ ID NO: 758457 - RNA, 64 nt, Homo Sapiens; identical to SEQ ID NO: 52345

SEQ ID NO: 758458 - RNA, 64 nt, Homo Sapiens; identical to SEQ ID NO: 52346

SEQ ID NO: 758459 - RNA, 64 nt, Homo Sapiens; identical to SEQ ID NO: 52347

SEQ ID NO: 758460 - RNA, 64 nt, Homo Sapiens; identical to SEQ ID NO: 52348

SEQ ID NO: 758461 - RNA, 64 nt, Homo Sapiens; identical to SEQ ID NO: 52349

SEQ ID NO: 758462 - RNA, 64 nt, Homo Sapiens; identical to SEQ ID NO: 52350

SEQ ID NO: 758463 - RNA, 64 nt, Homo Sapiens; identical to SEQ ID NO: 52351

SEQ ID NO: 758464 - RNA, 64 nt, Homo Sapiens; identical to SEQ ID NO: 52352

SEQ ID NO: 758465 - RNA, 64 nt, Homo Sapiens; identical to SEQ ID NO: 52353

SEQ ID NO: 758466 - RNA, 64 nt, Homo Sapiens; identical to SEQ ID NO: 52354

SEQ ID NO: 758467 - RNA, 64 nt, Homo Sapiens; identical to SEQ ID NO: 52355

SEQ ID NO: 758468 - RNA, 64 nt, Homo Sapiens; identical to SEQ ID NO: 52356

SEQ ID NO: 758469 - RNA, 64 nt, Homo Sapiens; identical to SEQ ID NO: 52357

SEQ ID NO: 758470 - RNA, 64 nt, Homo Sapiens; identical to SEQ ID NO: 52358

SEQ ID NO: 758471 - RNA, 64 nt, Homo Sapiens; identical to SEQ ID NO: 52359

SEQ ID NO: 758472 - RNA, 64 nt, Homo Sapiens; identical to SEQ ID NO: 52360

SEQ ID NO: 758473 - RNA, 59 nt, Homo Sapiens; identical to SEQ ID NO: 52361

SEQ ID NO: 758474 - RNA, 64 nt, Homo Sapiens; identical to SEQ ID NO: 52362

SEQ ID NO: 758475 - RNA, 64 nt, Homo Sapiens; identical to SEQ ID NO: 52363

SEQ ID NO: 758476 - RNA, 64 nt, Homo Sapiens; identical to SEQ ID NO: 52364

SEQ ID NO: 758477 - RNA, 64 nt, Homo Sapiens; identical to SEQ ID NO: 52365

SEQ ID NO: 758478 - RNA, 64 nt, Homo Sapiens; identical to SEQ ID NO: 52366

SEQ ID NO: 758479 - RNA, 64 nt, Homo Sapiens; identical to SEQ ID NO: 52367

SEQ ID NO: 758480 - RNA, 64 nt, Homo Sapiens; identical to SEQ ID NO: 52368

SEQ ID NO: 758481 - RNA, 64 nt, Homo Sapiens; identical to SEQ ID NO: 52369

SEQ ID NO: 758482 - RNA, 64 nt, Homo Sapiens; identical to SEQ ID NO: 52370

SEQ ID NO: 758483 - RNA, 64 nt, Homo Sapiens; identical to SEQ ID NO: 52371

SEQ ID NO: 758484 - RNA, 64 nt, Homo Sapiens; identical to SEQ ID NO: 52372

SEQ ID NO: 758485 - RNA, 64 nt, Homo Sapiens; identical to SEQ ID NO: 52373

SEQ ID NO: 758486 - RNA, 64 nt, Homo Sapiens; identical to SEQ ID NO: 52374

SEQ ID NO: 758487 - RNA, 64 nt, Homo Sapiens; identical to SEQ ID NO: 52375

SEQ ID NO: 758488 - RNA, 64 nt, Homo Sapiens; identical to SEQ ID NO: 249571

SEQ ID NO: 758489 - RNA, 64 nt, Homo Sapiens; identical to SEQ ID NO: 249572

SEQ ID NO: 758490 - RNA, 64 nt, Homo Sapiens; identical to SEQ ID NO: 249573

SEQ ID NO: 758491 - RNA, 64 nt, Homo Sapiens; identical to SEQ ID NO: 249574

SEQ ID NO: 758492 - RNA, 64 nt, Homo Sapiens; identical to SEQ ID NO: 249575

SEQ ID NO: 758493 - RNA, 64 nt, Homo Sapiens; identical to SEQ ID NO: 249576

SEQ ID NO: 758494 - RNA, 64 nt, Homo Sapiens; identical to SEQ ID NO: 249577

SEQ ID NO: 758495 - RNA, 64 nt, Homo Sapiens; identical to SEQ ID NO: 249578

SEQ ID NO: 758496 - RNA, 64 nt, Homo Sapiens; identical to SEQ ID NO: 249579

SEQ ID NO: 758497 - RNA, 64 nt, Homo Sapiens; identical to SEQ ID NO: 249580

SEQ ID NO: 758498 - RNA, 64 nt, Homo Sapiens; identical to SEQ ID NO: 249581

SEQ ID NO: 758499 - RNA, 64 nt, Homo Sapiens; identical to SEQ ID NO: 249582

SEQ ID NO: 758500 - RNA, 64 nt, Homo Sapiens; identical to SEQ ID NO: 249583

SEQ ID NO: 758501 - RNA, 64 nt, Homo Sapiens; identical to SEQ ID NO: 249584

SEQ ID NO: 758502 - RNA, 64 nt, Homo Sapiens; identical to SEQ ID NO: 249585

SEQ ID NO: 758503 - RNA, 64 nt, Homo Sapiens; identical to SEQ ID NO: 249586

SEQ ID NO: 758504 - RNA, 64 nt, Homo Sapiens; identical to SEQ ID NO: 249587

SEQ ID NO: 758505 - RNA, 64 nt, Homo Sapiens; identical to SEQ ID NO: 249588

SEQ ID NO: 758506 - RNA, 64 nt, Homo Sapiens; identical to SEQ ID NO: 249589

SEQ ID NO: 758507 - RNA, 64 nt, Homo Sapiens; identical to SEQ ID NO: 249590

SEQ ID NO: 758508 - RNA, 64 nt, Homo Sapiens; identical to SEQ ID NO: 249591

SEQ ID NO: 758509 - RNA, 64 nt, Homo Sapiens; identical to SEQ ID NO: 249592

SEQ ID NO: 758510 - RNA, 64 nt, Homo Sapiens; identical to SEQ ID NO: 249593

SEQ ID NO: 758511 - RNA, 64 nt, Homo Sapiens; identical to SEQ ID NO: 249594

SEQ ID NO: 758512 - RNA, 64 nt, Homo Sapiens; identical to SEQ ID NO: 249595

SEQ ID NO: 758513 - RNA, 64 nt, Homo Sapiens; identical to SEQ ID NO: 249596

SEQ ID NO: 758514 - RNA, 64 nt, Homo Sapiens; identical to SEQ ID NO: 249597

SEQ ID NO: 758515 - RNA, 64 nt, Homo Sapiens; identical to SEQ ID NO: 249598

SEQ ID NO: 758516 - RNA, 64 nt, Homo Sapiens; identical to SEQ ID NO: 249599

SEQ ID NO: 758517 - RNA, 64 nt, Homo Sapiens; identical to SEQ ID NO: 249600

SEQ ID NO: 758518 - RNA, 64 nt, Homo Sapiens; identical to SEQ ID NO: 249601

SEQ ID NO: 758519 - RNA, 64 nt, Homo Sapiens; identical to SEQ ID NO: 249602

SEQ ID NO: 758520 - RNA, 64 nt, Homo Sapiens; identical to SEQ ID NO: 249603

SEQ ID NO: 758521 - RNA, 64 nt, Homo Sapiens; identical to SEQ ID NO: 249604

SEQ ID NO: 758522 - RNA, 64 nt, Homo Sapiens; identical to SEQ ID NO: 249605

SEQ ID NO: 758523 - RNA, 64 nt, Homo Sapiens; identical to SEQ ID NO: 249606

SEQ ID NO: 758524 - RNA, 64 nt, Homo Sapiens; identical to SEQ ID NO: 217880

SEQ ID NO: 758525 - RNA, 64 nt, Homo Sapiens; identical to SEQ ID NO: 217881

SEQ ID NO: 758526 - RNA, 64 nt, Homo Sapiens; identical to SEQ ID NO: 217882

SEQ ID NO: 758527 - RNA, 64 nt, Homo Sapiens; identical to SEQ ID NO: 217883

SEQ ID NO: 758528 - RNA, 64 nt, Homo Sapiens; identical to SEQ ID NO: 217884

SEQ ID NO: 758529 - RNA, 64 nt, Homo Sapiens; identical to SEQ ID NO: 217885

SEQ ID NO: 758530 - RNA, 64 nt, Homo Sapiens; identical to SEQ ID NO: 217886

SEQ ID NO: 758531 - RNA, 64 nt, Homo Sapiens; identical to SEQ ID NO: 217887

SEQ ID NO: 758532 - RNA, 64 nt, Homo Sapiens; identical to SEQ ID NO: 217888

SEQ ID NO: 758533 - RNA, 64 nt, Homo Sapiens; identical to SEQ ID NO: 217889

SEQ ID NO: 758534 - RNA, 64 nt, Homo Sapiens; identical to SEQ ID NO: 217890

SEQ ID NO: 758535 - RNA, 64 nt, Homo Sapiens; identical to SEQ ID NO: 217891

SEQ ID NO: 758536 - RNA, 64 nt, Homo Sapiens; identical to SEQ ID NO: 217892

SEQ ID NO: 758537 - RNA, 64 nt, Homo Sapiens; identical to SEQ ID NO: 217893

SEQ ID NO: 758538 - RNA, 64 nt, Homo Sapiens; identical to SEQ ID NO: 217894

SEQ ID NO: 758539 - RNA, 64 nt, Homo Sapiens; identical to SEQ ID NO: 217895

SEQ ID NO: 758540 - RNA, 64 nt, Homo Sapiens; identical to SEQ ID NO: 217896

SEQ ID NO: 758541 - RNA, 64 nt, Homo Sapiens; identical to SEQ ID NO: 217897

SEQ ID NO: 758542 - RNA, 64 nt, Homo Sapiens; identical to SEQ ID NO: 217898

SEQ ID NO: 758543 - RNA, 64 nt, Homo Sapiens; identical to SEQ ID NO: 217899

SEQ ID NO: 758544 - RNA, 64 nt, Homo Sapiens; identical to SEQ ID NO: 217900

SEQ ID NO: 758545 - RNA, 64 nt, Homo Sapiens; identical to SEQ ID NO: 217901

SEQ ID NO: 758546 - RNA, 64 nt, Homo Sapiens; identical to SEQ ID NO: 217902

SEQ ID NO: 758547 - RNA, 64 nt, Homo Sapiens; identical to SEQ ID NO: 217903

SEQ ID NO: 758548 - RNA, 64 nt, Homo Sapiens; identical to SEQ ID NO: 217904

SEQ ID NO: 758549 - RNA, 64 nt, Homo Sapiens; identical to SEQ ID NO: 217905

SEQ ID NO: 758550 - RNA, 64 nt, Homo Sapiens; identical to SEQ ID NO: 217906

SEQ ID NO: 758551 - RNA, 64 nt, Homo Sapiens; identical to SEQ ID NO: 217907

SEQ ID NO: 758552 - RNA, 64 nt, Homo Sapiens; identical to SEQ ID NO: 217908

SEQ ID NO: 758553 - RNA, 64 nt, Homo Sapiens; identical to SEQ ID NO: 217909

SEQ ID NO: 758554 - RNA, 64 nt, Homo Sapiens; identical to SEQ ID NO: 217910

SEQ ID NO: 758555 - RNA, 64 nt, Homo Sapiens; identical to SEQ ID NO: 217911

SEQ ID NO: 758556 - RNA, 64 nt, Homo Sapiens; identical to SEQ ID NO: 484304

SEQ ID NO: 758557 - RNA, 64 nt, Homo Sapiens; identical to SEQ ID NO: 484305

SEQ ID NO: 758558 - RNA, 64 nt, Homo Sapiens; identical to SEQ ID NO: 484306

SEQ ID NO: 758559 - RNA, 64 nt, Homo Sapiens; identical to SEQ ID NO: 484307

SEQ ID NO: 758560 - RNA, 64 nt, Homo Sapiens; identical to SEQ ID NO: 484308

SEQ ID NO: 758561 - RNA, 64 nt, Homo Sapiens; identical to SEQ ID NO: 484309

SEQ ID NO: 758562 - RNA, 64 nt, Homo Sapiens; identical to SEQ ID NO: 484310

SEQ ID NO: 758563 - RNA, 64 nt, Homo Sapiens; identical to SEQ ID NO: 484311

SEQ ID NO: 758564 - RNA, 64 nt, Homo Sapiens; identical to SEQ ID NO: 484312

SEQ ID NO: 758565 - RNA, 64 nt, Homo Sapiens; identical to SEQ ID NO: 484313

SEQ ID NO: 758566 - RNA, 64 nt, Homo Sapiens; identical to SEQ ID NO: 484314

SEQ ID NO: 758567 - RNA, 64 nt, Homo Sapiens; identical to SEQ ID NO: 484315

SEQ ID NO: 758568 - RNA, 64 nt, Homo Sapiens; identical to SEQ ID NO: 73453

SEQ ID NO: 758569 - RNA, 64 nt, Homo Sapiens; identical to SEQ ID NO: 73454

SEQ ID NO: 758570 - RNA, 64 nt, Homo Sapiens; identical to SEQ ID NO: 73455

SEQ ID NO: 758571 - RNA, 64 nt, Homo Sapiens; identical to SEQ ID NO: 73456

SEQ ID NO: 758572 - RNA, 64 nt, Homo Sapiens; identical to SEQ ID NO: 73457

SEQ ID NO: 758573 - RNA, 64 nt, Homo Sapiens; identical to SEQ ID NO: 73458

SEQ ID NO: 758574 - RNA, 64 nt, Homo Sapiens; identical to SEQ ID NO: 73459

SEQ ID NO: 758575 - RNA, 64 nt, Homo Sapiens; identical to SEQ ID NO: 73460

SEQ ID NO: 758576 - RNA, 64 nt, Homo Sapiens; identical to SEQ ID NO: 73461

SEQ ID NO: 758577 - RNA, 64 nt, Homo Sapiens; identical to SEQ ID NO: 73462

SEQ ID NO: 758578 - RNA, 64 nt, Homo Sapiens; identical to SEQ ID NO: 73463

SEQ ID NO: 758579 - RNA, 64 nt, Homo Sapiens; identical to SEQ ID NO: 73464

SEQ ID NO: 758580 - RNA, 64 nt, Homo Sapiens; identical to SEQ ID NO: 73465

SEQ ID NO: 758581 - RNA, 64 nt, Homo Sapiens; identical to SEQ ID NO: 73466

SEQ ID NO: 758582 - RNA, 64 nt, Homo Sapiens; identical to SEQ ID NO: 73467

SEQ ID NO: 758583 - RNA, 64 nt, Homo Sapiens; identical to SEQ ID NO: 73468

SEQ ID NO: 758584 - RNA, 64 nt, Homo Sapiens; identical to SEQ ID NO: 73469

SEQ ID NO: 758585 - RNA, 64 nt, Homo Sapiens; identical to SEQ ID NO: 73470

SEQ ID NO: 758586 - RNA, 64 nt, Homo Sapiens; identical to SEQ ID NO: 73471

SEQ ID NO: 758587 - RNA, 64 nt, Homo Sapiens; identical to SEQ ID NO: 73472

SEQ ID NO: 758588 - RNA, 64 nt, Homo Sapiens; identical to SEQ ID NO: 73473

SEQ ID NO: 758589 - RNA, 64 nt, Homo Sapiens; identical to SEQ ID NO: 73474

SEQ ID NO: 758590 - RNA, 64 nt, Homo Sapiens; identical to SEQ ID NO: 73475

SEQ ID NO: 758591 - RNA, 64 nt, Homo Sapiens; identical to SEQ ID NO: 73476

SEQ ID NO: 758592 - RNA, 64 nt, Homo Sapiens; identical to SEQ ID NO: 73477

SEQ ID NO: 758593 - RNA, 64 nt, Homo Sapiens; identical to SEQ ID NO: 73478

SEQ ID NO: 758594 - RNA, 64 nt, Homo Sapiens; identical to SEQ ID NO: 73479

SEQ ID NO: 758595 - RNA, 64 nt, Homo Sapiens; identical to SEQ ID NO: 73480

SEQ ID NO: 758596 - RNA, 64 nt, Homo Sapiens; identical to SEQ ID NO: 73481

SEQ ID NO: 758597 - RNA, 64 nt, Homo Sapiens; identical to SEQ ID NO: 73482

SEQ ID NO: 758598 - RNA, 64 nt, Homo Sapiens; identical to SEQ ID NO: 73483

SEQ ID NO: 758599 - RNA, 64 nt, Homo Sapiens; identical to SEQ ID NO: 73484

SEQ ID NO: 758600 - RNA, 64 nt, Homo Sapiens; identical to SEQ ID NO: 73485

SEQ ID NO: 758601 - RNA, 64 nt, Homo Sapiens; identical to SEQ ID NO: 73486

SEQ ID NO: 758602 - RNA, 64 nt, Homo Sapiens; identical to SEQ ID NO: 73487

SEQ ID NO: 758603 - RNA, 64 nt, Homo Sapiens; identical to SEQ ID NO: 73488

SEQ ID NO: 758604 - RNA, 64 nt, Homo Sapiens; identical to SEQ ID NO: 73489

SEQ ID NO: 758605 - RNA, 64 nt, Homo Sapiens; identical to SEQ ID NO: 73490

SEQ ID NO: 758606 - RNA, 64 nt, Homo Sapiens; identical to SEQ ID NO: 73491

SEQ ID NO: 758607 - RNA, 64 nt, Homo Sapiens; identical to SEQ ID NO: 73492

SEQ ID NO: 758608 - RNA, 64 nt, Homo Sapiens; identical to SEQ ID NO: 73493

SEQ ID NO: 758609 - RNA, 64 nt, Homo Sapiens; identical to SEQ ID NO: 73494

SEQ ID NO: 758610 - RNA, 64 nt, Homo Sapiens; identical to SEQ ID NO: 73495

SEQ ID NO: 758611 - RNA, 64 nt, Homo Sapiens; identical to SEQ ID NO: 73496

SEQ ID NO: 758612 - RNA, 64 nt, Homo Sapiens; identical to SEQ ID NO: 73497

SEQ ID NO: 758613 - RNA, 64 nt, Homo Sapiens; identical to SEQ ID NO: 73498

SEQ ID NO: 758614 - RNA, 64 nt, Homo Sapiens; identical to SEQ ID NO: 73499

SEQ ID NO: 758615 - RNA, 64 nt, Homo Sapiens; identical to SEQ ID NO: 73500

SEQ ID NO: 758616 - RNA, 64 nt, Homo Sapiens; identical to SEQ ID NO: 73501

SEQ ID NO: 758617 - RNA, 64 nt, Homo Sapiens; identical to SEQ ID NO: 73502

SEQ ID NO: 758618 - RNA, 64 nt, Homo Sapiens; identical to SEQ ID NO: 73503

SEQ ID NO: 758619 - RNA, 64 nt, Homo Sapiens; identical to SEQ ID NO: 73504

SEQ ID NO: 758620 - RNA, 64 nt, Homo Sapiens; identical to SEQ ID NO: 73505

SEQ ID NO: 758621 - RNA, 64 nt, Homo Sapiens; identical to SEQ ID NO: 73506

SEQ ID NO: 758622 - RNA, 64 nt, Homo Sapiens; identical to SEQ ID NO: 73507

SEQ ID NO: 758623 - RNA, 64 nt, Homo Sapiens; identical to SEQ ID NO: 73508

SEQ ID NO: 758624 - RNA, 64 nt, Homo Sapiens; identical to SEQ ID NO: 73509

SEQ ID NO: 758625 - RNA, 64 nt, Homo Sapiens; identical to SEQ ID NO: 73510

SEQ ID NO: 758626 - RNA, 64 nt, Homo Sapiens; identical to SEQ ID NO: 73511

SEQ ID NO: 758627 - RNA, 64 nt, Homo Sapiens; identical to SEQ ID NO: 73512

SEQ ID NO: 758628 - RNA, 64 nt, Homo Sapiens; identical to SEQ ID NO: 73513

SEQ ID NO: 758629 - RNA, 62 nt, Homo Sapiens
ccugauuucccguaaaggugugcagccugagagacgggaagaggaggccucuggaccugcug

SEQ ID NO: 758630 - RNA, 62 nt, Homo Sapiens
caaacgaggaauuuaaaaaacaugugcacugggacgggaagucucgcggcagcugucauuuc

SEQ ID NO: 758631 - RNA, 62 nt, Homo Sapiens
uggcuugaacucaggaguucaggccgaggugagacgggaagauguaaucccagcacuuugag

SEQ ID NO: 758632 - RNA, 62 nt, Homo Sapiens
cugcagagacaaugcugugaccuaaacuuuuugacgggaacagucuucaugauuaaauucag

SEQ ID NO: 758633 - RNA, 62 nt, Homo Sapiens
aagagguaugaagaugggcuuuacccauagaagacgggaagaaaacucaaccacucuggaau

SEQ ID NO: 758634 - RNA, 62 nt, Homo Sapiens
gguacaucuuuuuuuccuuauauuucuuuauugacgggaagauuuauagcuuuaauuugugu

SEQ ID NO: 758635 - RNA, 62 nt, Homo Sapiens
ggacauuuccagaacuaccaugagaugguuuagacgggaauucaugcaaaugaggggucaaa

SEQ ID NO: 758636 - RNA, 62 nt, Homo Sapiens
caucagcgaguuauuguaacuggucaccacuggacgggaaggagaacagaggagagggaaag

SEQ ID NO: 758637 - RNA, 62 nt, Homo Sapiens
gaugcugguggcuggugagaccccgcacugcagacgggaaugccuaggucccuucccgaccc

SEQ ID NO: 758638 - RNA, 62 nt, Homo Sapiens
gccgugcccccuugggcgcacugggguugggggacgggaagauuccuuucggacccuuuuag

SEQ ID NO: 758639 - RNA, 62 nt, Homo Sapiens
acacauuaugcuaauguugauguuagugcagugacgggaaauugguuugaaguuuaguuuaa

SEQ ID NO: 758640 - RNA, 62 nt, Homo Sapiens
aaaacuagguaaaaucuacacuuuauguguuugacgggaaacggugggaaagauuacuuuuu

SEQ ID NO: 758641 - RNA, 62 nt, Homo Sapiens
gugaagcaggauauuagcucagguuaggaugggacgggaaaauucgucaaccgguacuuuua

SEQ ID NO: 758642 - RNA, 62 nt, Homo Sapiens
gcucuuuaauuauuagugaugacuacgaugaggacgggaacuagucccgccacuuccagaua

SEQ ID NO: 758643 - RNA, 62 nt, Homo Sapiens
ccuccuuccugcuucagggcgucggggcccaagacgggaacuggcugggggacuuccugcug

SEQ ID NO: 758644 - RNA, 62 nt, Homo Sapiens
uaugaagcucuugauaggacuuccuuaagcaugacgggaaaaccaaacacguucccuaauca

SEQ ID NO: 758645 - RNA, 62 nt, Homo Sapiens
guggccuguugugugugugcccucugagccuggacgggaaguccuugagacuuggagcccug

SEQ ID NO: 758646 - RNA, 62 nt, Homo Sapiens
ggaccucaaacuuccuuuccacaagauucugugacgggaaacaaugggggaguauuuccgaa

SEQ ID NO: 758647 - RNA, 62 nt, Homo Sapiens
accuggcuccaagaagcaucgcuggucuuggggacgggaagggaacccucuuccaggagcuc

SEQ ID NO: 758648 - RNA, 62 nt, Homo Sapiens
cuaacuuaagccaugacuuuuagauaugagaugacgggaagcaggacgaaauaucggcgugu

SEQ ID NO: 758649 - RNA, 62 nt, Homo Sapiens
acacagcauagcuuugaaauaagaggugaggugacgggaaauucuagaacaguacaagguua

SEQ ID NO: 758650 - RNA, 62 nt, Homo Sapiens
ucagagccaggcgugucuugacgguaucugcugacgggaacaagucauucugaaaggucccu

SEQ ID NO: 758651 - RNA, 62 nt, Homo Sapiens
ccaggguggggcccaccaagauuccugaucaugacgggaagcugagugacccugaggccuua

SEQ ID NO: 758652 - RNA, 59 nt, Homo Sapiens
gugauucuccugucuucuaaauaaucagugacgggaagauggaagggcaugaugaacuc

SEQ ID NO: 758653 - RNA, 62 nt, Homo Sapiens
ggacucugcagccaaggcagugcuuugaguuggacgggaaugcacauccagcauugucccag

SEQ ID NO: 758654 - RNA, 62 nt, Homo Sapiens
cccgccgccccacaccucuccccuuugggcuggacgggaacacacguguguggcucaggagg

SEQ ID NO: 758655 - RNA, 62 nt, Homo Sapiens
acuggggcagagggcgccugcacuacgucuuggacgggaaucuuuuuugucucugaaauuug

SEQ ID NO: 758656 - RNA, 62 nt, Homo Sapiens
agaaccacuucuccuguccaugagacuucccagacgggaaucuuacuccugaaccguguccc

SEQ ID NO: 758657 - RNA, 62 nt, Homo Sapiens
ccucucggugauauuuuuucuacgccaaaacagacgggaaagggaacaaaauaaagugaaau

SEQ ID NO: 758658 - RNA, 62 nt, Homo Sapiens
agaaggaggcaucguccaguaagaccgucccggacgggaagcuggugaaagguaugcugcca

SEQ ID NO: 758659 - RNA, 62 nt, Homo Sapiens
cgguguagcauggagauuaaucuuucuacauagacgggaacacauaggugggaagauacuca

SEQ ID NO: 758660 - RNA, 62 nt, Homo Sapiens
augucccauacuucccagcuugagugaagaaagacgggaauggaaacaagauaaucaguuac

SEQ ID NO: 758661 - RNA, 62 nt, Homo Sapiens
cacccuaaucuauuuagauucauacuuauugagacgggaaaaacucgcuguaaaauaaugcc

SEQ ID NO: 758662 - RNA, 62 nt, Homo Sapiens
cgcuacugguuuuauugccccaccaagucuuggacgggaagggcacuuugguucaaggggcc

SEQ ID NO: 758663 - RNA, 62 nt, Homo Sapiens
gcagggcggcugcaguuucaugccaccugguggacgggaaagaugacagccugggguccuug

SEQ ID NO: 758664 - RNA, 62 nt, Homo Sapiens
uugacgaccugcaugacuuccuggaggugcuggacgggaagaagguggaguugaagagcuuc

SEQ ID NO: 758665 - RNA, 62 nt, Homo Sapiens
cauccacccaggucccgagcccucacacccuggacgggaagggacagcugcauuccagagca

SEQ ID NO: 758666 - RNA, 61 nt, Homo Sapiens
gagcagaucaucggaggugaggacagcgucugacgggaagccugaucuggaaccuucccaa

SEQ ID NO: 758667 - RNA, 62 nt, Homo Sapiens
cagucucccgcuguggggcaggaacaggaagugacgggaaccuugaggaggaaacgccugug

SEQ ID NO: 758668 - RNA, 62 nt, Homo Sapiens
auucuuaaacugauuaacuaaaaaaugugacugacgggaacagaaugaacuucugagggcca

SEQ ID NO: 758669 - RNA, 62 nt, Homo Sapiens
acccauccaggcccuggccagugugggaccgggacgggaaggaagaaggaggcuaggagcag

SEQ ID NO: 758670 - RNA, 62 nt, Homo Sapiens
acauuuauccaagaccugaaagaugggcaaaagacgggaagcaagaugugaaagaagagcag

SEQ ID NO: 758671 - RNA, 62 nt, Homo Sapiens
gcacugaucuggagaucugcagaucuggaggagacgggaaggagucgauucuuaaauaagga

SEQ ID NO: 758672 - RNA, 62 nt, Homo Sapiens
cauggggcagguccuggaacggauuuaagggagacgggaacacccggggcggguggagggug

SEQ ID NO: 758673 - RNA, 60 nt, Homo Sapiens
uaaggacgaagccuacaggguuaccuucaugacgggaaccugaaaaagaaacccuucuga

SEQ ID NO: 758674 - RNA, 62 nt, Homo Sapiens
aggaagcggggcagcagcacaagacacgggaugacgggaagcgaaacagcaagggcgggguc

SEQ ID NO: 758675 - RNA, 62 nt, Homo Sapiens
gaucccccugccugucgcaccccuuggcgggagacgggaaggcagcgggcugcguacgaugg

SEQ ID NO: 758676 - RNA, 61 nt, Homo Sapiens
uccgagucacgcucaauugaacccugccagagacgggaagaggggggcugucggcugcugc

SEQ ID NO: 758677 - RNA, 62 nt, Homo Sapiens
uuuauuuaaaauguucauuaauaaaguuguuggacgggaagcaaaaaaaaaaaguuguuuaa

SEQ ID NO: 758678 - RNA, 62 nt, Homo Sapiens
ggaagaguagagagggaggguggaccugucaagacgggaagguuaagagcccuagggcaggc

SEQ ID NO: 758679 - RNA, 62 nt, Homo Sapiens
gcagccagggccauguugcacaaggccugagagacgggaaagggcccgaucgcucuuucccg

SEQ ID NO: 758680 - RNA, 62 nt, Homo Sapiens
uccaaggaaggggccugguggaggcugcccaggacgggaaagagcuucagugugcaggcucu

SEQ ID NO: 758681 - RNA, 62 nt, Homo Sapiens
cagcucuuuccagagaauucucaguuuuaugagacgggaaacuuuauuucacgagaaagccu

SEQ ID NO: 758682 - RNA, 62 nt, Homo Sapiens
cguuuagcauggcaugagggccacauuccauggacgggaagaccccuuccucuucagagguc

SEQ ID NO: 758683 - RNA, 62 nt, Homo Sapiens
auacucgggaggcuaaggcaggagaaucgcuugacgggaagcggagguugcagugagccgag

SEQ ID NO: 758684 - RNA, 62 nt, Homo Sapiens
aggggucagcaaacuuuuucuguaaagggccagacgggaaauauuuugggcuuugcaggcca

SEQ ID NO: 758685 - RNA, 64 nt, Homo Sapiens; identical to SEQ ID NO: 179925

SEQ ID NO: 758686 - RNA, 64 nt, Homo Sapiens; identical to SEQ ID NO: 179926

SEQ ID NO: 758687 - RNA, 64 nt, Homo Sapiens; identical to SEQ ID NO: 179927

SEQ ID NO: 758688 - RNA, 64 nt, Homo Sapiens; identical to SEQ ID NO: 179928

SEQ ID NO: 758689 - RNA, 64 nt, Homo Sapiens; identical to SEQ ID NO: 179929

SEQ ID NO: 758690 - RNA, 64 nt, Homo Sapiens; identical to SEQ ID NO: 179930

SEQ ID NO: 758691 - RNA, 64 nt, Homo Sapiens; identical to SEQ ID NO: 179931

SEQ ID NO: 758692 - RNA, 64 nt, Homo Sapiens; identical to SEQ ID NO: 179932

SEQ ID NO: 758693 - RNA, 64 nt, Homo Sapiens; identical to SEQ ID NO: 179933

SEQ ID NO: 758694 - RNA, 64 nt, Homo Sapiens; identical to SEQ ID NO: 179934

SEQ ID NO: 758695 - RNA, 64 nt, Homo Sapiens; identical to SEQ ID NO: 179935

SEQ ID NO: 758696 - RNA, 64 nt, Homo Sapiens; identical to SEQ ID NO: 179936

SEQ ID NO: 758697 - RNA, 64 nt, Homo Sapiens; identical to SEQ ID NO: 179937

SEQ ID NO: 758698 - RNA, 64 nt, Homo Sapiens; identical to SEQ ID NO: 179938

SEQ ID NO: 758699 - RNA, 64 nt, Homo Sapiens; identical to SEQ ID NO: 179939

SEQ ID NO: 758700 - RNA, 64 nt, Homo Sapiens; identical to SEQ ID NO: 179940

SEQ ID NO: 758701 - RNA, 64 nt, Homo Sapiens; identical to SEQ ID NO: 179941

SEQ ID NO: 758702 - RNA, 64 nt, Homo Sapiens; identical to SEQ ID NO: 179942

SEQ ID NO: 758703 - RNA, 64 nt, Homo Sapiens; identical to SEQ ID NO: 179943

SEQ ID NO: 758704 - RNA, 64 nt, Homo Sapiens; identical to SEQ ID NO: 439551

SEQ ID NO: 758705 - RNA, 64 nt, Homo Sapiens; identical to SEQ ID NO: 439552

SEQ ID NO: 758706 - RNA, 64 nt, Homo Sapiens; identical to SEQ ID NO: 439553

SEQ ID NO: 758707 - RNA, 64 nt, Homo Sapiens; identical to SEQ ID NO: 439554

SEQ ID NO: 758708 - RNA, 64 nt, Homo Sapiens; identical to SEQ ID NO: 439555

SEQ ID NO: 758709 - RNA, 64 nt, Homo Sapiens; identical to SEQ ID NO: 439556

SEQ ID NO: 758710 - RNA, 64 nt, Homo Sapiens; identical to SEQ ID NO: 439557

SEQ ID NO: 758711 - RNA, 64 nt, Homo Sapiens; identical to SEQ ID NO: 439558

SEQ ID NO: 758712 - RNA, 64 nt, Homo Sapiens; identical to SEQ ID NO: 439559

SEQ ID NO: 758713 - RNA, 64 nt, Homo Sapiens; identical to SEQ ID NO: 439560

SEQ ID NO: 758714 - RNA, 64 nt, Homo Sapiens; identical to SEQ ID NO: 439561

SEQ ID NO: 758715 - RNA, 64 nt, Homo Sapiens; identical to SEQ ID NO: 439562

SEQ ID NO: 758716 - RNA, 64 nt, Homo Sapiens; identical to SEQ ID NO: 439563

SEQ ID NO: 758717 - RNA, 64 nt, Homo Sapiens; identical to SEQ ID NO: 439564

SEQ ID NO: 758718 - RNA, 64 nt, Homo Sapiens; identical to SEQ ID NO: 439565

SEQ ID NO: 758719 - RNA, 64 nt, Homo Sapiens; identical to SEQ ID NO: 439566

SEQ ID NO: 758720 - RNA, 64 nt, Homo Sapiens; identical to SEQ ID NO: 439567

SEQ ID NO: 758721 - RNA, 64 nt, Homo Sapiens; identical to SEQ ID NO: 439568

SEQ ID NO: 758722 - RNA, 64 nt, Homo Sapiens; identical to SEQ ID NO: 439569

SEQ ID NO: 758723 - RNA, 64 nt, Homo Sapiens; identical to SEQ ID NO: 439570

SEQ ID NO: 758724 - RNA, 64 nt, Homo Sapiens; identical to SEQ ID NO: 439571

SEQ ID NO: 758725 - RNA, 64 nt, Homo Sapiens; identical to SEQ ID NO: 439572

SEQ ID NO: 758726 - RNA, 64 nt, Homo Sapiens; identical to SEQ ID NO: 439573

SEQ ID NO: 758727 - RNA, 64 nt, Homo Sapiens; identical to SEQ ID NO: 439574

SEQ ID NO: 758728 - RNA, 64 nt, Homo Sapiens; identical to SEQ ID NO: 439575

SEQ ID NO: 758729 - RNA, 64 nt, Homo Sapiens; identical to SEQ ID NO: 439576

SEQ ID NO: 758730 - RNA, 64 nt, Homo Sapiens; identical to SEQ ID NO: 439577

SEQ ID NO: 758731 - RNA, 64 nt, Homo Sapiens; identical to SEQ ID NO: 439578

SEQ ID NO: 758732 - RNA, 64 nt, Homo Sapiens; identical to SEQ ID NO: 439579

SEQ ID NO: 758733 - RNA, 64 nt, Homo Sapiens; identical to SEQ ID NO: 439580

SEQ ID NO: 758734 - RNA, 64 nt, Homo Sapiens; identical to SEQ ID NO: 439581

SEQ ID NO: 758735 - RNA, 64 nt, Homo Sapiens; identical to SEQ ID NO: 439582

SEQ ID NO: 758736 - RNA, 64 nt, Homo Sapiens; identical to SEQ ID NO: 439583

SEQ ID NO: 758737 - RNA, 64 nt, Homo Sapiens; identical to SEQ ID NO: 439584

SEQ ID NO: 758738 - RNA, 64 nt, Homo Sapiens; identical to SEQ ID NO: 439585

SEQ ID NO: 758739 - RNA, 64 nt, Homo Sapiens; identical to SEQ ID NO: 439586

SEQ ID NO: 758740 - RNA, 64 nt, Homo Sapiens; identical to SEQ ID NO: 439587

SEQ ID NO: 758741 - RNA, 64 nt, Homo Sapiens; identical to SEQ ID NO: 439588

SEQ ID NO: 758742 - RNA, 64 nt, Homo Sapiens; identical to SEQ ID NO: 439589

SEQ ID NO: 758743 - RNA, 64 nt, Homo Sapiens; identical to SEQ ID NO: 439590

SEQ ID NO: 758744 - RNA, 64 nt, Homo Sapiens; identical to SEQ ID NO: 439591

SEQ ID NO: 758745 - RNA, 64 nt, Homo Sapiens; identical to SEQ ID NO: 439592

SEQ ID NO: 758746 - RNA, 64 nt, Homo Sapiens; identical to SEQ ID NO: 439593

SEQ ID NO: 758747 - RNA, 64 nt, Homo Sapiens; identical to SEQ ID NO: 439594

SEQ ID NO: 758748 - RNA, 64 nt, Homo Sapiens; identical to SEQ ID NO: 439595

SEQ ID NO: 758749 - RNA, 64 nt, Homo Sapiens; identical to SEQ ID NO: 439596

SEQ ID NO: 758750 - RNA, 64 nt, Homo Sapiens; identical to SEQ ID NO: 439597

SEQ ID NO: 758751 - RNA, 64 nt, Homo Sapiens; identical to SEQ ID NO: 439598

SEQ ID NO: 758752 - RNA, 53 nt, Homo Sapiens; identical to SEQ ID NO: 126861

SEQ ID NO: 758753 - RNA, 64 nt, Homo Sapiens; identical to SEQ ID NO: 126862

SEQ ID NO: 758754 - RNA, 64 nt, Homo Sapiens; identical to SEQ ID NO: 126863

SEQ ID NO: 758755 - RNA, 64 nt, Homo Sapiens; identical to SEQ ID NO: 126864

SEQ ID NO: 758756 - RNA, 64 nt, Homo Sapiens; identical to SEQ ID NO: 126865

SEQ ID NO: 758757 - RNA, 64 nt, Homo Sapiens; identical to SEQ ID NO: 126866

SEQ ID NO: 758758 - RNA, 64 nt, Homo Sapiens; identical to SEQ ID NO: 126867

SEQ ID NO: 758759 - RNA, 64 nt, Homo Sapiens; identical to SEQ ID NO: 126868

SEQ ID NO: 758760 - RNA, 64 nt, Homo Sapiens; identical to SEQ ID NO: 126869

SEQ ID NO: 758761 - RNA, 64 nt, Homo Sapiens; identical to SEQ ID NO: 126870

SEQ ID NO: 758762 - RNA, 64 nt, Homo Sapiens; identical to SEQ ID NO: 126871

SEQ ID NO: 758763 - RNA, 64 nt, Homo Sapiens; identical to SEQ ID NO: 126872

SEQ ID NO: 758764 - RNA, 64 nt, Homo Sapiens; identical to SEQ ID NO: 126873

SEQ ID NO: 758765 - RNA, 64 nt, Homo Sapiens; identical to SEQ ID NO: 126874

SEQ ID NO: 758766 - RNA, 64 nt, Homo Sapiens; identical to SEQ ID NO: 126875

SEQ ID NO: 758767 - RNA, 64 nt, Homo Sapiens; identical to SEQ ID NO: 126876

SEQ ID NO: 758768 - RNA, 64 nt, Homo Sapiens; identical to SEQ ID NO: 126877

SEQ ID NO: 758769 - RNA, 53 nt, Homo Sapiens; identical to SEQ ID NO: 126878

SEQ ID NO: 758770 - RNA, 64 nt, Homo Sapiens; identical to SEQ ID NO: 126879

SEQ ID NO: 758771 - RNA, 64 nt, Homo Sapiens; identical to SEQ ID NO: 126880

SEQ ID NO: 758772 - RNA, 64 nt, Homo Sapiens; identical to SEQ ID NO: 126881

SEQ ID NO: 758773 - RNA, 64 nt, Homo Sapiens; identical to SEQ ID NO: 126882

SEQ ID NO: 758774 - RNA, 64 nt, Homo Sapiens; identical to SEQ ID NO: 126883

SEQ ID NO: 758775 - RNA, 64 nt, Homo Sapiens; identical to SEQ ID NO: 126884

SEQ ID NO: 758776 - RNA, 64 nt, Homo Sapiens; identical to SEQ ID NO: 126885

SEQ ID NO: 758777 - RNA, 64 nt, Homo Sapiens; identical to SEQ ID NO: 126886

SEQ ID NO: 758778 - RNA, 64 nt, Homo Sapiens; identical to SEQ ID NO: 126887

SEQ ID NO: 758779 - RNA, 64 nt, Homo Sapiens; identical to SEQ ID NO: 126888

SEQ ID NO: 758780 - RNA, 64 nt, Homo Sapiens; identical to SEQ ID NO: 126889

SEQ ID NO: 758781 - RNA, 64 nt, Homo Sapiens; identical to SEQ ID NO: 126890

SEQ ID NO: 758782 - RNA, 64 nt, Homo Sapiens; identical to SEQ ID NO: 126891

SEQ ID NO: 758783 - RNA, 64 nt, Homo Sapiens; identical to SEQ ID NO: 126892

SEQ ID NO: 758784 - RNA, 64 nt, Homo Sapiens; identical to SEQ ID NO: 126893

SEQ ID NO: 758785 - RNA, 64 nt, Homo Sapiens; identical to SEQ ID NO: 126894

SEQ ID NO: 758786 - RNA, 64 nt, Homo Sapiens; identical to SEQ ID NO: 126895

SEQ ID NO: 758787 - RNA, 64 nt, Homo Sapiens; identical to SEQ ID NO: 126896

SEQ ID NO: 758788 - RNA, 64 nt, Homo Sapiens; identical to SEQ ID NO: 126897

SEQ ID NO: 758789 - RNA, 64 nt, Homo Sapiens; identical to SEQ ID NO: 126898

SEQ ID NO: 758790 - RNA, 64 nt, Homo Sapiens; identical to SEQ ID NO: 126899

SEQ ID NO: 758791 - RNA, 64 nt, Homo Sapiens; identical to SEQ ID NO: 126900

SEQ ID NO: 758792 - RNA, 64 nt, Homo Sapiens; identical to SEQ ID NO: 126901

SEQ ID NO: 758793 - RNA, 64 nt, Homo Sapiens; identical to SEQ ID NO: 126902

SEQ ID NO: 758794 - RNA, 64 nt, Homo Sapiens; identical to SEQ ID NO: 126903

SEQ ID NO: 758795 - RNA, 64 nt, Homo Sapiens; identical to SEQ ID NO: 126904

SEQ ID NO: 758796 - RNA, 64 nt, Homo Sapiens; identical to SEQ ID NO: 126905

SEQ ID NO: 758797 - RNA, 64 nt, Homo Sapiens; identical to SEQ ID NO: 126906

SEQ ID NO: 758798 - RNA, 64 nt, Homo Sapiens; identical to SEQ ID NO: 126907

SEQ ID NO: 758799 - RNA, 64 nt, Homo Sapiens; identical to SEQ ID NO: 126908

SEQ ID NO: 758800 - RNA, 64 nt, Homo Sapiens; identical to SEQ ID NO: 126909

SEQ ID NO: 758801 - RNA, 64 nt, Homo Sapiens; identical to SEQ ID NO: 126910

SEQ ID NO: 758802 - RNA, 64 nt, Homo Sapiens; identical to SEQ ID NO: 126911

SEQ ID NO: 758803 - RNA, 64 nt, Homo Sapiens; identical to SEQ ID NO: 126912

SEQ ID NO: 758804 - RNA, 64 nt, Homo Sapiens; identical to SEQ ID NO: 126913

SEQ ID NO: 758805 - RNA, 64 nt, Homo Sapiens; identical to SEQ ID NO: 126914

SEQ ID NO: 758806 - RNA, 64 nt, Homo Sapiens; identical to SEQ ID NO: 126915

SEQ ID NO: 758807 - RNA, 64 nt, Homo Sapiens; identical to SEQ ID NO: 126916

SEQ ID NO: 758808 - RNA, 64 nt, Homo Sapiens; identical to SEQ ID NO: 126917

SEQ ID NO: 758809 - RNA, 64 nt, Homo Sapiens; identical to SEQ ID NO: 126918

SEQ ID NO: 758810 - RNA, 64 nt, Homo Sapiens; identical to SEQ ID NO: 126919

SEQ ID NO: 758811 - RNA, 64 nt, Homo Sapiens; identical to SEQ ID NO: 126920

SEQ ID NO: 758812 - RNA, 64 nt, Homo Sapiens; identical to SEQ ID NO: 126921

SEQ ID NO: 758813 - RNA, 64 nt, Homo Sapiens; identical to SEQ ID NO: 126922

SEQ ID NO: 758814 - RNA, 64 nt, Homo Sapiens; identical to SEQ ID NO: 126923

SEQ ID NO: 758815 - RNA, 64 nt, Homo Sapiens; identical to SEQ ID NO: 126924

SEQ ID NO: 758816 - RNA, 64 nt, Homo Sapiens; identical to SEQ ID NO: 126925

SEQ ID NO: 758817 - RNA, 64 nt, Homo Sapiens; identical to SEQ ID NO: 126926

SEQ ID NO: 758818 - RNA, 64 nt, Homo Sapiens; identical to SEQ ID NO: 126927

SEQ ID NO: 758819 - RNA, 64 nt, Homo Sapiens; identical to SEQ ID NO: 126928

SEQ ID NO: 758820 - RNA, 64 nt, Homo Sapiens; identical to SEQ ID NO: 126929

SEQ ID NO: 758821 - RNA, 64 nt, Homo Sapiens; identical to SEQ ID NO: 126930

SEQ ID NO: 758822 - RNA, 64 nt, Homo Sapiens; identical to SEQ ID NO: 126931

SEQ ID NO: 758823 - RNA, 64 nt, Homo Sapiens; identical to SEQ ID NO: 126932

SEQ ID NO: 758824 - RNA, 64 nt, Homo Sapiens; identical to SEQ ID NO: 126933

SEQ ID NO: 758825 - RNA, 64 nt, Homo Sapiens; identical to SEQ ID NO: 126934

SEQ ID NO: 758826 - RNA, 64 nt, Homo Sapiens; identical to SEQ ID NO: 126935

SEQ ID NO: 758827 - RNA, 64 nt, Homo Sapiens; identical to SEQ ID NO: 126936

SEQ ID NO: 758828 - RNA, 64 nt, Homo Sapiens; identical to SEQ ID NO: 126937

SEQ ID NO: 758829 - RNA, 64 nt, Homo Sapiens; identical to SEQ ID NO: 126938

SEQ ID NO: 758830 - RNA, 64 nt, Homo Sapiens; identical to SEQ ID NO: 126939

SEQ ID NO: 758831 - RNA, 55 nt, Homo Sapiens; identical to SEQ ID NO: 126940

SEQ ID NO: 758832 - RNA, 64 nt, Homo Sapiens; identical to SEQ ID NO: 126941

SEQ ID NO: 758833 - RNA, 64 nt, Homo Sapiens; identical to SEQ ID NO: 126942

SEQ ID NO: 758834 - RNA, 64 nt, Homo Sapiens; identical to SEQ ID NO: 126943

SEQ ID NO: 758835 - RNA, 64 nt, Homo Sapiens; identical to SEQ ID NO: 126944

SEQ ID NO: 758836 - RNA, 64 nt, Homo Sapiens; identical to SEQ ID NO: 126945

SEQ ID NO: 758837 - RNA, 64 nt, Homo Sapiens; identical to SEQ ID NO: 126946

SEQ ID NO: 758838 - RNA, 64 nt, Homo Sapiens; identical to SEQ ID NO: 126947

SEQ ID NO: 758839 - RNA, 64 nt, Homo Sapiens; identical to SEQ ID NO: 126948

SEQ ID NO: 758840 - RNA, 64 nt, Homo Sapiens; identical to SEQ ID NO: 126949

SEQ ID NO: 758841 - RNA, 64 nt, Homo Sapiens; identical to SEQ ID NO: 126950

SEQ ID NO: 758842 - RNA, 64 nt, Homo Sapiens; identical to SEQ ID NO: 126951

SEQ ID NO: 758843 - RNA, 64 nt, Homo Sapiens; identical to SEQ ID NO: 126952

SEQ ID NO: 758844 - RNA, 64 nt, Homo Sapiens; identical to SEQ ID NO: 126953

SEQ ID NO: 758845 - RNA, 64 nt, Homo Sapiens; identical to SEQ ID NO: 126954

SEQ ID NO: 758846 - RNA, 64 nt, Homo Sapiens; identical to SEQ ID NO: 126955

SEQ ID NO: 758847 - RNA, 64 nt, Homo Sapiens; identical to SEQ ID NO: 126956

SEQ ID NO: 758848 - RNA, 64 nt, Homo Sapiens; identical to SEQ ID NO: 126957

SEQ ID NO: 758849 - RNA, 64 nt, Homo Sapiens; identical to SEQ ID NO: 126958

SEQ ID NO: 758850 - RNA, 64 nt, Homo Sapiens; identical to SEQ ID NO: 126959

SEQ ID NO: 758851 - RNA, 64 nt, Homo Sapiens; identical to SEQ ID NO: 126960

SEQ ID NO: 758852 - RNA, 64 nt, Homo Sapiens; identical to SEQ ID NO: 126961

SEQ ID NO: 758853 - RNA, 64 nt, Homo Sapiens; identical to SEQ ID NO: 126962

SEQ ID NO: 758854 - RNA, 64 nt, Homo Sapiens; identical to SEQ ID NO: 126963

SEQ ID NO: 758855 - RNA, 64 nt, Homo Sapiens; identical to SEQ ID NO: 126964

SEQ ID NO: 758856 - RNA, 64 nt, Homo Sapiens; identical to SEQ ID NO: 126965

SEQ ID NO: 758857 - RNA, 64 nt, Homo Sapiens; identical to SEQ ID NO: 126966

SEQ ID NO: 758858 - RNA, 64 nt, Homo Sapiens; identical to SEQ ID NO: 126967

SEQ ID NO: 758859 - RNA, 64 nt, Homo Sapiens; identical to SEQ ID NO: 126968

SEQ ID NO: 758860 - RNA, 64 nt, Homo Sapiens; identical to SEQ ID NO: 126969

SEQ ID NO: 758861 - RNA, 64 nt, Homo Sapiens; identical to SEQ ID NO: 126970

SEQ ID NO: 758862 - RNA, 64 nt, Homo Sapiens; identical to SEQ ID NO: 126971

SEQ ID NO: 758863 - RNA, 64 nt, Homo Sapiens; identical to SEQ ID NO: 126972

SEQ ID NO: 758864 - RNA, 64 nt, Homo Sapiens; identical to SEQ ID NO: 126973

SEQ ID NO: 758865 - RNA, 64 nt, Homo Sapiens; identical to SEQ ID NO: 126974

SEQ ID NO: 758866 - RNA, 64 nt, Homo Sapiens; identical to SEQ ID NO: 126975

SEQ ID NO: 758867 - RNA, 64 nt, Homo Sapiens; identical to SEQ ID NO: 126976

SEQ ID NO: 758868 - RNA, 64 nt, Homo Sapiens; identical to SEQ ID NO: 126977

SEQ ID NO: 758869 - RNA, 64 nt, Homo Sapiens; identical to SEQ ID NO: 126978

SEQ ID NO: 758870 - RNA, 64 nt, Homo Sapiens; identical to SEQ ID NO: 126979

SEQ ID NO: 758871 - RNA, 64 nt, Homo Sapiens; identical to SEQ ID NO: 126980

SEQ ID NO: 758872 - RNA, 64 nt, Homo Sapiens; identical to SEQ ID NO: 126981

SEQ ID NO: 758873 - RNA, 64 nt, Homo Sapiens; identical to SEQ ID NO: 126982

SEQ ID NO: 758874 - RNA, 64 nt, Homo Sapiens; identical to SEQ ID NO: 126983

SEQ ID NO: 758875 - RNA, 64 nt, Homo Sapiens; identical to SEQ ID NO: 126984

SEQ ID NO: 758876 - RNA, 64 nt, Homo Sapiens; identical to SEQ ID NO: 126985

SEQ ID NO: 758877 - RNA, 64 nt, Homo Sapiens; identical to SEQ ID NO: 126986

SEQ ID NO: 758878 - RNA, 64 nt, Homo Sapiens; identical to SEQ ID NO: 126987

SEQ ID NO: 758879 - RNA, 60 nt, Homo Sapiens; identical to SEQ ID NO: 126988

SEQ ID NO: 758880 - RNA, 64 nt, Homo Sapiens; identical to SEQ ID NO: 126989

SEQ ID NO: 758881 - RNA, 64 nt, Homo Sapiens; identical to SEQ ID NO: 126990

SEQ ID NO: 758882 - RNA, 64 nt, Homo Sapiens; identical to SEQ ID NO: 126991

SEQ ID NO: 758883 - RNA, 64 nt, Homo Sapiens; identical to SEQ ID NO: 126992

SEQ ID NO: 758884 - RNA, 64 nt, Homo Sapiens; identical to SEQ ID NO: 126993

SEQ ID NO: 758885 - RNA, 64 nt, Homo Sapiens; identical to SEQ ID NO: 126994

SEQ ID NO: 758886 - RNA, 64 nt, Homo Sapiens; identical to SEQ ID NO: 84437

SEQ ID NO: 758887 - RNA, 64 nt, Homo Sapiens; identical to SEQ ID NO: 84438

SEQ ID NO: 758888 - RNA, 64 nt, Homo Sapiens; identical to SEQ ID NO: 209951

SEQ ID NO: 758889 - RNA, 64 nt, Homo Sapiens; identical to SEQ ID NO: 209952

SEQ ID NO: 758890 - RNA, 64 nt, Homo Sapiens; identical to SEQ ID NO: 209953

SEQ ID NO: 758891 - RNA, 64 nt, Homo Sapiens; identical to SEQ ID NO: 209954

SEQ ID NO: 758892 - RNA, 64 nt, Homo Sapiens; identical to SEQ ID NO: 209955

SEQ ID NO: 758893 - RNA, 64 nt, Homo Sapiens; identical to SEQ ID NO: 209956

SEQ ID NO: 758894 - RNA, 64 nt, Homo Sapiens; identical to SEQ ID NO: 209957

SEQ ID NO: 758895 - RNA, 64 nt, Homo Sapiens; identical to SEQ ID NO: 209958

SEQ ID NO: 758896 - RNA, 64 nt, Homo Sapiens; identical to SEQ ID NO: 209959

SEQ ID NO: 758897 - RNA, 64 nt, Homo Sapiens; identical to SEQ ID NO: 209960

SEQ ID NO: 758898 - RNA, 64 nt, Homo Sapiens; identical to SEQ ID NO: 209961

SEQ ID NO: 758899 - RNA, 64 nt, Homo Sapiens; identical to SEQ ID NO: 209962

SEQ ID NO: 758900 - RNA, 64 nt, Homo Sapiens; identical to SEQ ID NO: 209963

SEQ ID NO: 758901 - RNA, 64 nt, Homo Sapiens; identical to SEQ ID NO: 209964

SEQ ID NO: 758902 - RNA, 64 nt, Homo Sapiens; identical to SEQ ID NO: 209965

SEQ ID NO: 758903 - RNA, 64 nt, Homo Sapiens; identical to SEQ ID NO: 209966

SEQ ID NO: 758904 - RNA, 64 nt, Homo Sapiens; identical to SEQ ID NO: 209967

SEQ ID NO: 758905 - RNA, 64 nt, Homo Sapiens; identical to SEQ ID NO: 209968

SEQ ID NO: 758906 - RNA, 64 nt, Homo Sapiens; identical to SEQ ID NO: 209969

SEQ ID NO: 758907 - RNA, 64 nt, Homo Sapiens; identical to SEQ ID NO: 209970

SEQ ID NO: 758908 - RNA, 64 nt, Homo Sapiens; identical to SEQ ID NO: 209971

SEQ ID NO: 758909 - RNA, 64 nt, Homo Sapiens; identical to SEQ ID NO: 209972

SEQ ID NO: 758910 - RNA, 64 nt, Homo Sapiens; identical to SEQ ID NO: 209973

SEQ ID NO: 758911 - RNA, 64 nt, Homo Sapiens; identical to SEQ ID NO: 209974

SEQ ID NO: 758912 - RNA, 64 nt, Homo Sapiens; identical to SEQ ID NO: 209975

SEQ ID NO: 758913 - RNA, 64 nt, Homo Sapiens; identical to SEQ ID NO: 209976

SEQ ID NO: 758914 - RNA, 64 nt, Homo Sapiens; identical to SEQ ID NO: 209977

SEQ ID NO: 758915 - RNA, 64 nt, Homo Sapiens; identical to SEQ ID NO: 209978

SEQ ID NO: 758916 - RNA, 64 nt, Homo Sapiens; identical to SEQ ID NO: 209979

SEQ ID NO: 758917 - RNA, 64 nt, Homo Sapiens; identical to SEQ ID NO: 209980

SEQ ID NO: 758918 - RNA, 64 nt, Homo Sapiens; identical to SEQ ID NO: 209981

SEQ ID NO: 758919 - RNA, 64 nt, Homo Sapiens; identical to SEQ ID NO: 209982

SEQ ID NO: 758920 - RNA, 64 nt, Homo Sapiens; identical to SEQ ID NO: 209983

SEQ ID NO: 758921 - RNA, 64 nt, Homo Sapiens; identical to SEQ ID NO: 209984

SEQ ID NO: 758922 - RNA, 64 nt, Homo Sapiens; identical to SEQ ID NO: 209985

SEQ ID NO: 758923 - RNA, 64 nt, Homo Sapiens; identical to SEQ ID NO: 209986

SEQ ID NO: 758924 - RNA, 64 nt, Homo Sapiens; identical to SEQ ID NO: 209987

SEQ ID NO: 758925 - RNA, 64 nt, Homo Sapiens; identical to SEQ ID NO: 209988

SEQ ID NO: 758926 - RNA, 64 nt, Homo Sapiens; identical to SEQ ID NO: 209989

SEQ ID NO: 758927 - RNA, 64 nt, Homo Sapiens; identical to SEQ ID NO: 209990

SEQ ID NO: 758928 - RNA, 64 nt, Homo Sapiens; identical to SEQ ID NO: 209991

SEQ ID NO: 758929 - RNA, 64 nt, Homo Sapiens; identical to SEQ ID NO: 209992

SEQ ID NO: 758930 - RNA, 64 nt, Homo Sapiens; identical to SEQ ID NO: 209993

SEQ ID NO: 758931 - RNA, 64 nt, Homo Sapiens; identical to SEQ ID NO: 209994

SEQ ID NO: 758932 - RNA, 64 nt, Homo Sapiens; identical to SEQ ID NO: 209995

SEQ ID NO: 758933 - RNA, 64 nt, Homo Sapiens; identical to SEQ ID NO: 209996

SEQ ID NO: 758934 - RNA, 64 nt, Homo Sapiens; identical to SEQ ID NO: 209997

SEQ ID NO: 758935 - RNA, 64 nt, Homo Sapiens; identical to SEQ ID NO: 209998

SEQ ID NO: 758936 - RNA, 64 nt, Homo Sapiens; identical to SEQ ID NO: 209999

SEQ ID NO: 758937 - RNA, 64 nt, Homo Sapiens; identical to SEQ ID NO: 210000

SEQ ID NO: 758938 - RNA, 64 nt, Homo Sapiens; identical to SEQ ID NO: 210001

SEQ ID NO: 758939 - RNA, 64 nt, Homo Sapiens; identical to SEQ ID NO: 210002

SEQ ID NO: 758940 - RNA, 64 nt, Homo Sapiens; identical to SEQ ID NO: 210003

SEQ ID NO: 758941 - RNA, 64 nt, Homo Sapiens; identical to SEQ ID NO: 210004

SEQ ID NO: 758942 - RNA, 64 nt, Homo Sapiens; identical to SEQ ID NO: 210005

SEQ ID NO: 758943 - RNA, 64 nt, Homo Sapiens; identical to SEQ ID NO: 210006

SEQ ID NO: 758944 - RNA, 64 nt, Homo Sapiens; identical to SEQ ID NO: 210007

SEQ ID NO: 758945 - RNA, 64 nt, Homo Sapiens; identical to SEQ ID NO: 210008

SEQ ID NO: 758946 - RNA, 64 nt, Homo Sapiens; identical to SEQ ID NO: 210009

SEQ ID NO: 758947 - RNA, 64 nt, Homo Sapiens; identical to SEQ ID NO: 210010

SEQ ID NO: 758948 - RNA, 64 nt, Homo Sapiens; identical to SEQ ID NO: 210011

SEQ ID NO: 758949 - RNA, 64 nt, Homo Sapiens; identical to SEQ ID NO: 210012

SEQ ID NO: 758950 - RNA, 64 nt, Homo Sapiens; identical to SEQ ID NO: 210013

SEQ ID NO: 758951 - RNA, 64 nt, Homo Sapiens; identical to SEQ ID NO: 210014

SEQ ID NO: 758952 - RNA, 64 nt, Homo Sapiens; identical to SEQ ID NO: 210015

SEQ ID NO: 758953 - RNA, 64 nt, Homo Sapiens; identical to SEQ ID NO: 210016

SEQ ID NO: 758954 - RNA, 64 nt, Homo Sapiens; identical to SEQ ID NO: 210017

SEQ ID NO: 758955 - RNA, 64 nt, Homo Sapiens; identical to SEQ ID NO: 210018

SEQ ID NO: 758956 - RNA, 64 nt, Homo Sapiens; identical to SEQ ID NO: 210019

SEQ ID NO: 758957 - RNA, 64 nt, Homo Sapiens; identical to SEQ ID NO: 210020

SEQ ID NO: 758958 - RNA, 64 nt, Homo Sapiens; identical to SEQ ID NO: 210021

SEQ ID NO: 758959 - RNA, 64 nt, Homo Sapiens; identical to SEQ ID NO: 210022

SEQ ID NO: 758960 - RNA, 64 nt, Homo Sapiens; identical to SEQ ID NO: 210023

SEQ ID NO: 758961 - RNA, 64 nt, Homo Sapiens; identical to SEQ ID NO: 210024

SEQ ID NO: 758962 - RNA, 64 nt, Homo Sapiens; identical to SEQ ID NO: 210025

SEQ ID NO: 758963 - RNA, 64 nt, Homo Sapiens; identical to SEQ ID NO: 210026

SEQ ID NO: 758964 - RNA, 64 nt, Homo Sapiens; identical to SEQ ID NO: 210027

SEQ ID NO: 758965 - RNA, 64 nt, Homo Sapiens; identical to SEQ ID NO: 210028

SEQ ID NO: 758966 - RNA, 64 nt, Homo Sapiens; identical to SEQ ID NO: 210029

SEQ ID NO: 758967 - RNA, 64 nt, Homo Sapiens; identical to SEQ ID NO: 210030

SEQ ID NO: 758968 - RNA, 64 nt, Homo Sapiens; identical to SEQ ID NO: 210031

SEQ ID NO: 758969 - RNA, 64 nt, Homo Sapiens; identical to SEQ ID NO: 210032

SEQ ID NO: 758970 - RNA, 64 nt, Homo Sapiens; identical to SEQ ID NO: 210033

SEQ ID NO: 758971 - RNA, 64 nt, Homo Sapiens; identical to SEQ ID NO: 210034

SEQ ID NO: 758972 - RNA, 64 nt, Homo Sapiens; identical to SEQ ID NO: 210035

SEQ ID NO: 758973 - RNA, 64 nt, Homo Sapiens; identical to SEQ ID NO: 210036

SEQ ID NO: 758974 - RNA, 64 nt, Homo Sapiens; identical to SEQ ID NO: 210037

SEQ ID NO: 758975 - RNA, 64 nt, Homo Sapiens; identical to SEQ ID NO: 210038

SEQ ID NO: 758976 - RNA, 64 nt, Homo Sapiens; identical to SEQ ID NO: 210039

SEQ ID NO: 758977 - RNA, 64 nt, Homo Sapiens; identical to SEQ ID NO: 210040

SEQ ID NO: 758978 - RNA, 64 nt, Homo Sapiens; identical to SEQ ID NO: 210041

SEQ ID NO: 758979 - RNA, 64 nt, Homo Sapiens; identical to SEQ ID NO: 210042

SEQ ID NO: 758980 - RNA, 64 nt, Homo Sapiens; identical to SEQ ID NO: 210043

SEQ ID NO: 758981 - RNA, 64 nt, Homo Sapiens; identical to SEQ ID NO: 210044

SEQ ID NO: 758982 - RNA, 64 nt, Homo Sapiens; identical to SEQ ID NO: 210045

SEQ ID NO: 758983 - RNA, 64 nt, Homo Sapiens; identical to SEQ ID NO: 210046

SEQ ID NO: 758984 - RNA, 64 nt, Homo Sapiens; identical to SEQ ID NO: 210047

SEQ ID NO: 758985 - RNA, 64 nt, Homo Sapiens; identical to SEQ ID NO: 210048

SEQ ID NO: 758986 - RNA, 64 nt, Homo Sapiens; identical to SEQ ID NO: 210049

SEQ ID NO: 758987 - RNA, 64 nt, Homo Sapiens; identical to SEQ ID NO: 210050

SEQ ID NO: 758988 - RNA, 64 nt, Homo Sapiens; identical to SEQ ID NO: 210051

SEQ ID NO: 758989 - RNA, 64 nt, Homo Sapiens; identical to SEQ ID NO: 210052

SEQ ID NO: 758990 - RNA, 56 nt, Homo Sapiens; identical to SEQ ID NO: 210053

SEQ ID NO: 758991 - RNA, 64 nt, Homo Sapiens; identical to SEQ ID NO: 210054

SEQ ID NO: 758992 - RNA, 64 nt, Homo Sapiens; identical to SEQ ID NO: 210055

SEQ ID NO: 758993 - RNA, 64 nt, Homo Sapiens; identical to SEQ ID NO: 210056

SEQ ID NO: 758994 - RNA, 64 nt, Homo Sapiens; identical to SEQ ID NO: 210057

SEQ ID NO: 758995 - RNA, 64 nt, Homo Sapiens; identical to SEQ ID NO: 210058

SEQ ID NO: 758996 - RNA, 64 nt, Homo Sapiens; identical to SEQ ID NO: 210059

SEQ ID NO: 758997 - RNA, 64 nt, Homo Sapiens; identical to SEQ ID NO: 210060

SEQ ID NO: 758998 - RNA, 64 nt, Homo Sapiens; identical to SEQ ID NO: 210061

SEQ ID NO: 758999 - RNA, 64 nt, Homo Sapiens; identical to SEQ ID NO: 210062

SEQ ID NO: 759000 - RNA, 64 nt, Homo Sapiens; identical to SEQ ID NO: 210063

SEQ ID NO: 759001 - RNA, 64 nt, Homo Sapiens; identical to SEQ ID NO: 210064

SEQ ID NO: 759002 - RNA, 64 nt, Homo Sapiens; identical to SEQ ID NO: 210065

SEQ ID NO: 759003 - RNA, 64 nt, Homo Sapiens; identical to SEQ ID NO: 210066

SEQ ID NO: 759004 - RNA, 64 nt, Homo Sapiens; identical to SEQ ID NO: 210067

SEQ ID NO: 759005 - RNA, 64 nt, Homo Sapiens; identical to SEQ ID NO: 210068

SEQ ID NO: 759006 - RNA, 64 nt, Homo Sapiens; identical to SEQ ID NO: 210069

SEQ ID NO: 759007 - RNA, 64 nt, Homo Sapiens; identical to SEQ ID NO: 210070

SEQ ID NO: 759008 - RNA, 55 nt, Homo Sapiens; identical to SEQ ID NO: 210071

SEQ ID NO: 759009 - RNA, 64 nt, Homo Sapiens; identical to SEQ ID NO: 210072

SEQ ID NO: 759010 - RNA, 64 nt, Homo Sapiens; identical to SEQ ID NO: 210073

SEQ ID NO: 759011 - RNA, 64 nt, Homo Sapiens; identical to SEQ ID NO: 210074

SEQ ID NO: 759012 - RNA, 64 nt, Homo Sapiens; identical to SEQ ID NO: 210075

SEQ ID NO: 759013 - RNA, 64 nt, Homo Sapiens; identical to SEQ ID NO: 210076

SEQ ID NO: 759014 - RNA, 64 nt, Homo Sapiens; identical to SEQ ID NO: 210077

SEQ ID NO: 759015 - RNA, 64 nt, Homo Sapiens; identical to SEQ ID NO: 210078

SEQ ID NO: 759016 - RNA, 64 nt, Homo Sapiens; identical to SEQ ID NO: 210079

SEQ ID NO: 759017 - RNA, 64 nt, Homo Sapiens; identical to SEQ ID NO: 210080

SEQ ID NO: 759018 - RNA, 64 nt, Homo Sapiens; identical to SEQ ID NO: 210081

SEQ ID NO: 759019 - RNA, 64 nt, Homo Sapiens; identical to SEQ ID NO: 210082

SEQ ID NO: 759020 - RNA, 64 nt, Homo Sapiens; identical to SEQ ID NO: 210083

SEQ ID NO: 759021 - RNA, 64 nt, Homo Sapiens; identical to SEQ ID NO: 210084

SEQ ID NO: 759022 - RNA, 64 nt, Homo Sapiens; identical to SEQ ID NO: 210085

SEQ ID NO: 759023 - RNA, 64 nt, Homo Sapiens; identical to SEQ ID NO: 210086

SEQ ID NO: 759024 - RNA, 64 nt, Homo Sapiens; identical to SEQ ID NO: 210087

SEQ ID NO: 759025 - RNA, 64 nt, Homo Sapiens; identical to SEQ ID NO: 210088

SEQ ID NO: 759026 - RNA, 64 nt, Homo Sapiens; identical to SEQ ID NO: 210089

SEQ ID NO: 759027 - RNA, 64 nt, Homo Sapiens; identical to SEQ ID NO: 210090

SEQ ID NO: 759028 - RNA, 64 nt, Homo Sapiens; identical to SEQ ID NO: 210091

SEQ ID NO: 759029 - RNA, 64 nt, Homo Sapiens; identical to SEQ ID NO: 210092

SEQ ID NO: 759030 - RNA, 64 nt, Homo Sapiens; identical to SEQ ID NO: 210093

SEQ ID NO: 759031 - RNA, 64 nt, Homo Sapiens; identical to SEQ ID NO: 210094

SEQ ID NO: 759032 - RNA, 64 nt, Homo Sapiens; identical to SEQ ID NO: 210095

SEQ ID NO: 759033 - RNA, 64 nt, Homo Sapiens; identical to SEQ ID NO: 210096

SEQ ID NO: 759034 - RNA, 64 nt, Homo Sapiens; identical to SEQ ID NO: 210097

SEQ ID NO: 759035 - RNA, 64 nt, Homo Sapiens; identical to SEQ ID NO: 210098

SEQ ID NO: 759036 - RNA, 64 nt, Homo Sapiens; identical to SEQ ID NO: 210099

SEQ ID NO: 759037 - RNA, 64 nt, Homo Sapiens; identical to SEQ ID NO: 210100

SEQ ID NO: 759038 - RNA, 64 nt, Homo Sapiens; identical to SEQ ID NO: 210101

SEQ ID NO: 759039 - RNA, 64 nt, Homo Sapiens; identical to SEQ ID NO: 210102

SEQ ID NO: 759040 - RNA, 64 nt, Homo Sapiens; identical to SEQ ID NO: 210103

SEQ ID NO: 759041 - RNA, 64 nt, Homo Sapiens; identical to SEQ ID NO: 210104

SEQ ID NO: 759042 - RNA, 64 nt, Homo Sapiens; identical to SEQ ID NO: 210105

SEQ ID NO: 759043 - RNA, 64 nt, Homo Sapiens; identical to SEQ ID NO: 210106

SEQ ID NO: 759044 - RNA, 64 nt, Homo Sapiens; identical to SEQ ID NO: 210107

SEQ ID NO: 759045 - RNA, 64 nt, Homo Sapiens; identical to SEQ ID NO: 210108

SEQ ID NO: 759046 - RNA, 64 nt, Homo Sapiens; identical to SEQ ID NO: 210109

SEQ ID NO: 759047 - RNA, 64 nt, Homo Sapiens; identical to SEQ ID NO: 210110

SEQ ID NO: 759048 - RNA, 64 nt, Homo Sapiens; identical to SEQ ID NO: 210111

SEQ ID NO: 759049 - RNA, 64 nt, Homo Sapiens; identical to SEQ ID NO: 210112

SEQ ID NO: 759050 - RNA, 64 nt, Homo Sapiens; identical to SEQ ID NO: 210113

SEQ ID NO: 759051 - RNA, 63 nt, Homo Sapiens; identical to SEQ ID NO: 210114

SEQ ID NO: 759052 - RNA, 60 nt, Homo Sapiens; identical to SEQ ID NO: 210115

SEQ ID NO: 759053 - RNA, 57 nt, Homo Sapiens; identical to SEQ ID NO: 210116

SEQ ID NO: 759054 - RNA, 64 nt, Homo Sapiens; identical to SEQ ID NO: 210117

SEQ ID NO: 759055 - RNA, 64 nt, Homo Sapiens; identical to SEQ ID NO: 210118

SEQ ID NO: 759056 - RNA, 64 nt, Homo Sapiens; identical to SEQ ID NO: 210119

SEQ ID NO: 759057 - RNA, 64 nt, Homo Sapiens; identical to SEQ ID NO: 210120

SEQ ID NO: 759058 - RNA, 64 nt, Homo Sapiens; identical to SEQ ID NO: 210121

SEQ ID NO: 759059 - RNA, 64 nt, Homo Sapiens; identical to SEQ ID NO: 210122

SEQ ID NO: 759060 - RNA, 64 nt, Homo Sapiens; identical to SEQ ID NO: 210123

SEQ ID NO: 759061 - RNA, 64 nt, Homo Sapiens; identical to SEQ ID NO: 210124

SEQ ID NO: 759062 - RNA, 64 nt, Homo Sapiens; identical to SEQ ID NO: 210125

SEQ ID NO: 759063 - RNA, 64 nt, Homo Sapiens; identical to SEQ ID NO: 210126

SEQ ID NO: 759064 - RNA, 64 nt, Homo Sapiens; identical to SEQ ID NO: 210127

SEQ ID NO: 759065 - RNA, 64 nt, Homo Sapiens; identical to SEQ ID NO: 210128

SEQ ID NO: 759066 - RNA, 64 nt, Homo Sapiens; identical to SEQ ID NO: 210129

SEQ ID NO: 759067 - RNA, 64 nt, Homo Sapiens; identical to SEQ ID NO: 210130

SEQ ID NO: 759068 - RNA, 64 nt, Homo Sapiens; identical to SEQ ID NO: 210131

SEQ ID NO: 759069 - RNA, 60 nt, Homo Sapiens
uuaaugguguuacagcauuugcaaaaauuauucugcuaaguauuuacaacucuauuuauu

SEQ ID NO: 759070 - RNA, 60 nt, Homo Sapiens
uugucgugguuaccagugcagccugucaaauucugcuauuugacacagcuuuggaaagau

SEQ ID NO: 759071 - RNA, 60 nt, Homo Sapiens
cuggcuaaaucugcucauuauccucuuccuuucugcuagccuaacuccugcacagccccg

SEQ ID NO: 759072 - RNA, 60 nt, Homo Sapiens
uccugcacagccccguccucagaaucaagauucugcuaaccaaguaccgaccauagagca

SEQ ID NO: 759073 - RNA, 60 nt, Homo Sapiens
gguauauguugaucugaacuaaugaauaaauucugcuagucucacagcuuaauauuuggu

SEQ ID NO: 759074 - RNA, 60 nt, Homo Sapiens
gcccagggauacaauggcaaguauaacacauucugcuaagcacacuugaccaucuacuuu

SEQ ID NO: 759075 - RNA, 60 nt, Homo Sapiens
ugucauccccacuuuagucacgagaucuuuuucugcuaacuguucauagucuguguagug

SEQ ID NO: 759076 - RNA, 60 nt, Homo Sapiens
gcugguucuaauauuaacagaacugcagucuucugcuagccaauagcauuuaccugaugg

SEQ ID NO: 759077 - RNA, 64 nt, Homo Sapiens
gugacguccugaagagccagggaaguccaccugucugguccauaccuugccaugcuguuggccu

SEQ ID NO: 759078 - RNA, 64 nt, Homo Sapiens
ccggcagaaguuacaguagacccaggaauuccaccugguccacauuuucaucuugccugggaag

SEQ ID NO: 759079 - RNA, 64 nt, Homo Sapiens
caugggucccuucccccugcgaaggaggaagggacugguccagguccuggacccagcaggggca

SEQ ID NO: 759080 - RNA, 64 nt, Homo Sapiens
ccaggccucauccuccuggauggaacaggaggaacugguccaggccauccccauguguuucagg

SEQ ID NO: 759081 - RNA, 64 nt, Homo Sapiens
ggcuuuggugagggcgccucuucucagggacaggcugguccagucugaagccccucugugucuc

SEQ ID NO: 759082 - RNA, 64 nt, Homo Sapiens
uggcauuugggaaagcagaugcucaccaaugcgucugguccacaagguaggcagggcgucccug

SEQ ID NO: 759083 - RNA, 64 nt, Homo Sapiens
uuucucucucccauaacagugcagugauagucagcugguccaggccaggcaaggggcuggucca

SEQ ID NO: 759084 - RNA, 64 nt, Homo Sapiens
agugauagucagcugguccaggccaggcaaggggcugguccaugaugucaucaggcacccaggu

SEQ ID NO: 759085 - RNA, 64 nt, Homo Sapiens
ugguguucacuuugcuccucuugcccucugucuucugguccaggcagaucaggggcucugggga

SEQ ID NO: 759086 - RNA, 64 nt, Homo Sapiens
ucuggagaagugacacaggauuuacuggggugggcugguccagguagcucuccugaaccuccuc

SEQ ID NO: 759087 - RNA, 64 nt, Homo Sapiens
acagauucugccugagccucaacacagauucugccugguccaacggcuggagucuggcuggucc

SEQ ID NO: 759088 - RNA, 64 nt, Homo Sapiens
acagauucugccugguccaagggcuggagucuggcugguccaacagcugccuggccacugggcu

SEQ ID NO: 759089 - RNA, 64 nt, Homo Sapiens; identical to SEQ ID NO: 352415

SEQ ID NO: 759090 - RNA, 64 nt, Homo Sapiens; identical to SEQ ID NO: 352416

SEQ ID NO: 759091 - RNA, 64 nt, Homo Sapiens; identical to SEQ ID NO: 352417

SEQ ID NO: 759092 - RNA, 64 nt, Homo Sapiens; identical to SEQ ID NO: 352418

SEQ ID NO: 759093 - RNA, 64 nt, Homo Sapiens; identical to SEQ ID NO: 352419

SEQ ID NO: 759094 - RNA, 64 nt, Homo Sapiens; identical to SEQ ID NO: 352420

SEQ ID NO: 759095 - RNA, 64 nt, Homo Sapiens; identical to SEQ ID NO: 352421

SEQ ID NO: 759096 - RNA, 64 nt, Homo Sapiens; identical to SEQ ID NO: 352422

SEQ ID NO: 759097 - RNA, 64 nt, Homo Sapiens; identical to SEQ ID NO: 352423

SEQ ID NO: 759098 - RNA, 64 nt, Homo Sapiens; identical to SEQ ID NO: 352424

SEQ ID NO: 759099 - RNA, 64 nt, Homo Sapiens; identical to SEQ ID NO: 352425

SEQ ID NO: 759100 - RNA, 64 nt, Homo Sapiens; identical to SEQ ID NO: 352426

SEQ ID NO: 759101 - RNA, 64 nt, Homo Sapiens; identical to SEQ ID NO: 352427

SEQ ID NO: 759102 - RNA, 64 nt, Homo Sapiens; identical to SEQ ID NO: 352428

SEQ ID NO: 759103 - RNA, 64 nt, Homo Sapiens; identical to SEQ ID NO: 352429

SEQ ID NO: 759104 - RNA, 64 nt, Homo Sapiens; identical to SEQ ID NO: 352430

SEQ ID NO: 759105 - RNA, 64 nt, Homo Sapiens; identical to SEQ ID NO: 352431

SEQ ID NO: 759106 - RNA, 64 nt, Homo Sapiens; identical to SEQ ID NO: 352432

SEQ ID NO: 759107 - RNA, 64 nt, Homo Sapiens; identical to SEQ ID NO: 352433

SEQ ID NO: 759108 - RNA, 64 nt, Homo Sapiens; identical to SEQ ID NO: 352434

SEQ ID NO: 759109 - RNA, 64 nt, Homo Sapiens; identical to SEQ ID NO: 352435

SEQ ID NO: 759110 - RNA, 64 nt, Homo Sapiens; identical to SEQ ID NO: 352436

SEQ ID NO: 759111 - RNA, 64 nt, Homo Sapiens; identical to SEQ ID NO: 352437

SEQ ID NO: 759112 - RNA, 64 nt, Homo Sapiens; identical to SEQ ID NO: 352438

SEQ ID NO: 759113 - RNA, 64 nt, Homo Sapiens; identical to SEQ ID NO: 352439

SEQ ID NO: 759114 - RNA, 64 nt, Homo Sapiens; identical to SEQ ID NO: 352440

SEQ ID NO: 759115 - RNA, 64 nt, Homo Sapiens; identical to SEQ ID NO: 352441

SEQ ID NO: 759116 - RNA, 64 nt, Homo Sapiens; identical to SEQ ID NO: 352442

SEQ ID NO: 759117 - RNA, 64 nt, Homo Sapiens; identical to SEQ ID NO: 352443

SEQ ID NO: 759118 - RNA, 64 nt, Homo Sapiens; identical to SEQ ID NO: 352444

SEQ ID NO: 759119 - RNA, 64 nt, Homo Sapiens; identical to SEQ ID NO: 352445

SEQ ID NO: 759120 - RNA, 64 nt, Homo Sapiens; identical to SEQ ID NO: 352446

SEQ ID NO: 759121 - RNA, 64 nt, Homo Sapiens; identical to SEQ ID NO: 352447

SEQ ID NO: 759122 - RNA, 64 nt, Homo Sapiens; identical to SEQ ID NO: 352448

SEQ ID NO: 759123 - RNA, 64 nt, Homo Sapiens; identical to SEQ ID NO: 352449

SEQ ID NO: 759124 - RNA, 64 nt, Homo Sapiens; identical to SEQ ID NO: 352450

SEQ ID NO: 759125 - RNA, 64 nt, Homo Sapiens; identical to SEQ ID NO: 352451

SEQ ID NO: 759126 - RNA, 64 nt, Homo Sapiens; identical to SEQ ID NO: 352452

SEQ ID NO: 759127 - RNA, 64 nt, Homo Sapiens; identical to SEQ ID NO: 352453

SEQ ID NO: 759128 - RNA, 64 nt, Homo Sapiens; identical to SEQ ID NO: 352454

SEQ ID NO: 759129 - RNA, 64 nt, Homo Sapiens; identical to SEQ ID NO: 352455

SEQ ID NO: 759130 - RNA, 64 nt, Homo Sapiens; identical to SEQ ID NO: 352456

SEQ ID NO: 759131 - RNA, 64 nt, Homo Sapiens; identical to SEQ ID NO: 352457

SEQ ID NO: 759132 - RNA, 64 nt, Homo Sapiens; identical to SEQ ID NO: 352458

SEQ ID NO: 759133 - RNA, 64 nt, Homo Sapiens; identical to SEQ ID NO: 352459

SEQ ID NO: 759134 - RNA, 64 nt, Homo Sapiens; identical to SEQ ID NO: 352460

SEQ ID NO: 759135 - RNA, 64 nt, Homo Sapiens; identical to SEQ ID NO: 352461

SEQ ID NO: 759136 - RNA, 64 nt, Homo Sapiens; identical to SEQ ID NO: 352462

SEQ ID NO: 759137 - RNA, 64 nt, Homo Sapiens; identical to SEQ ID NO: 352463

SEQ ID NO: 759138 - RNA, 64 nt, Homo Sapiens; identical to SEQ ID NO: 352464

SEQ ID NO: 759139 - RNA, 64 nt, Homo Sapiens; identical to SEQ ID NO: 352465

SEQ ID NO: 759140 - RNA, 64 nt, Homo Sapiens; identical to SEQ ID NO: 352466

SEQ ID NO: 759141 - RNA, 64 nt, Homo Sapiens; identical to SEQ ID NO: 175633

SEQ ID NO: 759142 - RNA, 64 nt, Homo Sapiens; identical to SEQ ID NO: 175634

SEQ ID NO: 759143 - RNA, 64 nt, Homo Sapiens; identical to SEQ ID NO: 175635

SEQ ID NO: 759144 - RNA, 64 nt, Homo Sapiens; identical to SEQ ID NO: 175636

SEQ ID NO: 759145 - RNA, 64 nt, Homo Sapiens; identical to SEQ ID NO: 175637

SEQ ID NO: 759146 - RNA, 64 nt, Homo Sapiens; identical to SEQ ID NO: 175638

SEQ ID NO: 759147 - RNA, 64 nt, Homo Sapiens; identical to SEQ ID NO: 175639

SEQ ID NO: 759148 - RNA, 64 nt, Homo Sapiens; identical to SEQ ID NO: 175640

SEQ ID NO: 759149 - RNA, 64 nt, Homo Sapiens; identical to SEQ ID NO: 175641

SEQ ID NO: 759150 - RNA, 64 nt, Homo Sapiens; identical to SEQ ID NO: 175642

SEQ ID NO: 759151 - RNA, 64 nt, Homo Sapiens; identical to SEQ ID NO: 175643

SEQ ID NO: 759152 - RNA, 64 nt, Homo Sapiens; identical to SEQ ID NO: 175644

SEQ ID NO: 759153 - RNA, 64 nt, Homo Sapiens; identical to SEQ ID NO: 175645

SEQ ID NO: 759154 - RNA, 64 nt, Homo Sapiens; identical to SEQ ID NO: 175646

SEQ ID NO: 759155 - RNA, 64 nt, Homo Sapiens; identical to SEQ ID NO: 175647

SEQ ID NO: 759156 - RNA, 64 nt, Homo Sapiens; identical to SEQ ID NO: 175648

SEQ ID NO: 759157 - RNA, 64 nt, Homo Sapiens; identical to SEQ ID NO: 175649

SEQ ID NO: 759158 - RNA, 64 nt, Homo Sapiens; identical to SEQ ID NO: 175650

SEQ ID NO: 759159 - RNA, 64 nt, Homo Sapiens; identical to SEQ ID NO: 175651

SEQ ID NO: 759160 - RNA, 64 nt, Homo Sapiens; identical to SEQ ID NO: 175652

SEQ ID NO: 759161 - RNA, 64 nt, Homo Sapiens; identical to SEQ ID NO: 175653

SEQ ID NO: 759162 - RNA, 64 nt, Homo Sapiens; identical to SEQ ID NO: 175654

SEQ ID NO: 759163 - RNA, 64 nt, Homo Sapiens; identical to SEQ ID NO: 175655

SEQ ID NO: 759164 - RNA, 64 nt, Homo Sapiens; identical to SEQ ID NO: 175656

SEQ ID NO: 759165 - RNA, 64 nt, Homo Sapiens; identical to SEQ ID NO: 175657

SEQ ID NO: 759166 - RNA, 64 nt, Homo Sapiens; identical to SEQ ID NO: 175658

SEQ ID NO: 759167 - RNA, 64 nt, Homo Sapiens; identical to SEQ ID NO: 175659

SEQ ID NO: 759168 - RNA, 64 nt, Homo Sapiens; identical to SEQ ID NO: 175660

SEQ ID NO: 759169 - RNA, 64 nt, Homo Sapiens; identical to SEQ ID NO: 175661

SEQ ID NO: 759170 - RNA, 64 nt, Homo Sapiens; identical to SEQ ID NO: 175662

SEQ ID NO: 759171 - RNA, 64 nt, Homo Sapiens; identical to SEQ ID NO: 175663

SEQ ID NO: 759172 - RNA, 64 nt, Homo Sapiens; identical to SEQ ID NO: 175664

SEQ ID NO: 759173 - RNA, 64 nt, Homo Sapiens; identical to SEQ ID NO: 175665

SEQ ID NO: 759174 - RNA, 64 nt, Homo Sapiens; identical to SEQ ID NO: 175666

SEQ ID NO: 759175 - RNA, 64 nt, Homo Sapiens; identical to SEQ ID NO: 175667

SEQ ID NO: 759176 - RNA, 64 nt, Homo Sapiens; identical to SEQ ID NO: 175668

SEQ ID NO: 759177 - RNA, 64 nt, Homo Sapiens; identical to SEQ ID NO: 175669

SEQ ID NO: 759178 - RNA, 64 nt, Homo Sapiens; identical to SEQ ID NO: 175670

SEQ ID NO: 759179 - RNA, 64 nt, Homo Sapiens; identical to SEQ ID NO: 175671

SEQ ID NO: 759180 - RNA, 64 nt, Homo Sapiens; identical to SEQ ID NO: 175672

SEQ ID NO: 759181 - RNA, 64 nt, Homo Sapiens; identical to SEQ ID NO: 175673

SEQ ID NO: 759182 - RNA, 64 nt, Homo Sapiens; identical to SEQ ID NO: 175674

SEQ ID NO: 759183 - RNA, 64 nt, Homo Sapiens; identical to SEQ ID NO: 175675

SEQ ID NO: 759184 - RNA, 64 nt, Homo Sapiens; identical to SEQ ID NO: 175676

SEQ ID NO: 759185 - RNA, 64 nt, Homo Sapiens; identical to SEQ ID NO: 175677

SEQ ID NO: 759186 - RNA, 64 nt, Homo Sapiens; identical to SEQ ID NO: 175678

SEQ ID NO: 759187 - RNA, 64 nt, Homo Sapiens; identical to SEQ ID NO: 175679

SEQ ID NO: 759188 - RNA, 64 nt, Homo Sapiens; identical to SEQ ID NO: 175680

SEQ ID NO: 759189 - RNA, 64 nt, Homo Sapiens; identical to SEQ ID NO: 175681

SEQ ID NO: 759190 - RNA, 64 nt, Homo Sapiens; identical to SEQ ID NO: 175682

SEQ ID NO: 759191 - RNA, 64 nt, Homo Sapiens; identical to SEQ ID NO: 175683

SEQ ID NO: 759192 - RNA, 64 nt, Homo Sapiens; identical to SEQ ID NO: 175684

SEQ ID NO: 759193 - RNA, 64 nt, Homo Sapiens; identical to SEQ ID NO: 175685

SEQ ID NO: 759194 - RNA, 64 nt, Homo Sapiens; identical to SEQ ID NO: 175686

SEQ ID NO: 759195 - RNA, 64 nt, Homo Sapiens; identical to SEQ ID NO: 175687

SEQ ID NO: 759196 - RNA, 64 nt, Homo Sapiens; identical to SEQ ID NO: 175688

SEQ ID NO: 759197 - RNA, 64 nt, Homo Sapiens; identical to SEQ ID NO: 175689

SEQ ID NO: 759198 - RNA, 64 nt, Homo Sapiens; identical to SEQ ID NO: 175690

SEQ ID NO: 759199 - RNA, 64 nt, Homo Sapiens; identical to SEQ ID NO: 175691

SEQ ID NO: 759200 - RNA, 64 nt, Homo Sapiens; identical to SEQ ID NO: 175692

SEQ ID NO: 759201 - RNA, 64 nt, Homo Sapiens; identical to SEQ ID NO: 175693

SEQ ID NO: 759202 - RNA, 64 nt, Homo Sapiens; identical to SEQ ID NO: 175694

SEQ ID NO: 759203 - RNA, 64 nt, Homo Sapiens; identical to SEQ ID NO: 175695

SEQ ID NO: 759204 - RNA, 64 nt, Homo Sapiens; identical to SEQ ID NO: 175696

SEQ ID NO: 759205 - RNA, 64 nt, Homo Sapiens; identical to SEQ ID NO: 175697

SEQ ID NO: 759206 - RNA, 64 nt, Homo Sapiens; identical to SEQ ID NO: 175698

SEQ ID NO: 759207 - RNA, 64 nt, Homo Sapiens; identical to SEQ ID NO: 175699

SEQ ID NO: 759208 - RNA, 64 nt, Homo Sapiens; identical to SEQ ID NO: 175700

SEQ ID NO: 759209 - RNA, 64 nt, Homo Sapiens; identical to SEQ ID NO: 175701

SEQ ID NO: 759210 - RNA, 64 nt, Homo Sapiens; identical to SEQ ID NO: 175702

SEQ ID NO: 759211 - RNA, 64 nt, Homo Sapiens; identical to SEQ ID NO: 175703

SEQ ID NO: 759212 - RNA, 64 nt, Homo Sapiens; identical to SEQ ID NO: 175704

SEQ ID NO: 759213 - RNA, 64 nt, Homo Sapiens; identical to SEQ ID NO: 175705

SEQ ID NO: 759214 - RNA, 64 nt, Homo Sapiens; identical to SEQ ID NO: 175706

SEQ ID NO: 759215 - RNA, 64 nt, Homo Sapiens; identical to SEQ ID NO: 175707

SEQ ID NO: 759216 - RNA, 64 nt, Homo Sapiens; identical to SEQ ID NO: 175708

SEQ ID NO: 759217 - RNA, 64 nt, Homo Sapiens; identical to SEQ ID NO: 175709

SEQ ID NO: 759218 - RNA, 64 nt, Homo Sapiens; identical to SEQ ID NO: 175710

SEQ ID NO: 759219 - RNA, 64 nt, Homo Sapiens; identical to SEQ ID NO: 175711

SEQ ID NO: 759220 - RNA, 64 nt, Homo Sapiens; identical to SEQ ID NO: 175712

SEQ ID NO: 759221 - RNA, 64 nt, Homo Sapiens; identical to SEQ ID NO: 175713

SEQ ID NO: 759222 - RNA, 64 nt, Homo Sapiens; identical to SEQ ID NO: 175714

SEQ ID NO: 759223 - RNA, 64 nt, Homo Sapiens; identical to SEQ ID NO: 175715

SEQ ID NO: 759224 - RNA, 64 nt, Homo Sapiens; identical to SEQ ID NO: 175716

SEQ ID NO: 759225 - RNA, 64 nt, Homo Sapiens; identical to SEQ ID NO: 175717

SEQ ID NO: 759226 - RNA, 64 nt, Homo Sapiens; identical to SEQ ID NO: 175718

SEQ ID NO: 759227 - RNA, 64 nt, Homo Sapiens; identical to SEQ ID NO: 175719

SEQ ID NO: 759228 - RNA, 64 nt, Homo Sapiens; identical to SEQ ID NO: 175720

SEQ ID NO: 759229 - RNA, 64 nt, Homo Sapiens; identical to SEQ ID NO: 175721

SEQ ID NO: 759230 - RNA, 64 nt, Homo Sapiens; identical to SEQ ID NO: 175722

SEQ ID NO: 759231 - RNA, 64 nt, Homo Sapiens; identical to SEQ ID NO: 175723

SEQ ID NO: 759232 - RNA, 64 nt, Homo Sapiens; identical to SEQ ID NO: 175724

SEQ ID NO: 759233 - RNA, 64 nt, Homo Sapiens; identical to SEQ ID NO: 175725

SEQ ID NO: 759234 - RNA, 64 nt, Homo Sapiens; identical to SEQ ID NO: 175726

SEQ ID NO: 759235 - RNA, 64 nt, Homo Sapiens; identical to SEQ ID NO: 175727

SEQ ID NO: 759236 - RNA, 53 nt, Homo Sapiens; identical to SEQ ID NO: 615283

SEQ ID NO: 759237 - RNA, 64 nt, Homo Sapiens; identical to SEQ ID NO: 615284

SEQ ID NO: 759238 - RNA, 64 nt, Homo Sapiens; identical to SEQ ID NO: 615285

SEQ ID NO: 759239 - RNA, 64 nt, Homo Sapiens; identical to SEQ ID NO: 615286

SEQ ID NO: 759240 - RNA, 64 nt, Homo Sapiens; identical to SEQ ID NO: 615287

SEQ ID NO: 759241 - RNA, 64 nt, Homo Sapiens; identical to SEQ ID NO: 615288

SEQ ID NO: 759242 - RNA, 64 nt, Homo Sapiens; identical to SEQ ID NO: 615289

SEQ ID NO: 759243 - RNA, 64 nt, Homo Sapiens; identical to SEQ ID NO: 615290

SEQ ID NO: 759244 - RNA, 64 nt, Homo Sapiens; identical to SEQ ID NO: 615291

SEQ ID NO: 759245 - RNA, 62 nt, Homo Sapiens; identical to SEQ ID NO: 615292

SEQ ID NO: 759246 - RNA, 64 nt, Homo Sapiens; identical to SEQ ID NO: 615293

SEQ ID NO: 759247 - RNA, 64 nt, Homo Sapiens; identical to SEQ ID NO: 615294

SEQ ID NO: 759248 - RNA, 64 nt, Homo Sapiens; identical to SEQ ID NO: 615295

SEQ ID NO: 759249 - RNA, 64 nt, Homo Sapiens; identical to SEQ ID NO: 615296

SEQ ID NO: 759250 - RNA, 64 nt, Homo Sapiens; identical to SEQ ID NO: 615297

SEQ ID NO: 759251 - RNA, 64 nt, Homo Sapiens; identical to SEQ ID NO: 615298

SEQ ID NO: 759252 - RNA, 64 nt, Homo Sapiens; identical to SEQ ID NO: 615299

SEQ ID NO: 759253 - RNA, 64 nt, Homo Sapiens; identical to SEQ ID NO: 615300

SEQ ID NO: 759254 - RNA, 64 nt, Homo Sapiens; identical to SEQ ID NO: 615301

SEQ ID NO: 759255 - RNA, 64 nt, Homo Sapiens; identical to SEQ ID NO: 615302

SEQ ID NO: 759256 - RNA, 64 nt, Homo Sapiens; identical to SEQ ID NO: 615303

SEQ ID NO: 759257 - RNA, 64 nt, Homo Sapiens; identical to SEQ ID NO: 615304

SEQ ID NO: 759258 - RNA, 64 nt, Homo Sapiens; identical to SEQ ID NO: 615305

SEQ ID NO: 759259 - RNA, 64 nt, Homo Sapiens; identical to SEQ ID NO: 615306

SEQ ID NO: 759260 - RNA, 64 nt, Homo Sapiens; identical to SEQ ID NO: 615307

SEQ ID NO: 759261 - RNA, 64 nt, Homo Sapiens; identical to SEQ ID NO: 615308

SEQ ID NO: 759262 - RNA, 64 nt, Homo Sapiens; identical to SEQ ID NO: 615309

SEQ ID NO: 759263 - RNA, 64 nt, Homo Sapiens; identical to SEQ ID NO: 615310

SEQ ID NO: 759264 - RNA, 64 nt, Homo Sapiens; identical to SEQ ID NO: 615311

SEQ ID NO: 759265 - RNA, 64 nt, Homo Sapiens
guuguauaacugaccuguguguacucucaauaaaggcugaaaauugaauuuuggcaugaugacu

SEQ ID NO: 759266 - RNA, 64 nt, Homo Sapiens
auagguacaucuguuuucacguaugcuaucuguaggcugaaauuaugaauaaugaccuuaugaa

SEQ ID NO: 759267 - RNA, 64 nt, Homo Sapiens
ucacuauucacaggacauuggcauuaucuacuaaggcugaaaaugugcauauuccaugacucag

SEQ ID NO: 759268 - RNA, 64 nt, Homo Sapiens
aaauaauaacagacaaggucaaaaaauagaugcaggcugaaaagaaaaggaagugggcuaagau

SEQ ID NO: 759269 - RNA, 64 nt, Homo Sapiens
uauacccgugaagcaugacuuauuguaagauguuggcugaaagcaugaacuugcagaacucccu

SEQ ID NO: 759270 - RNA, 64 nt, Homo Sapiens
uucccuuuuguugaucuacuugaccaagcaaaggggcugaaaaacugaauaaggaaacaacuuu

SEQ ID NO: 759271 - RNA, 60 nt, Homo Sapiens
cucccaaagagccauuucaacagagaagggaaaugacaaaggggcagcuggccagauaag

SEQ ID NO: 759272 - RNA, 60 nt, Homo Sapiens
agagauaaucgugucuuaaaaguuguuuuuaaaugacaauaaaacaagccagaaugucuu

SEQ ID NO: 759273 - RNA, 60 nt, Homo Sapiens
gaaccuuuccagagaagucccauuaguaagaaaugacauaaaauacgugcuuucucaggu

SEQ ID NO: 759274 - RNA, 60 nt, Homo Sapiens
uaaaauccaggccuagacucaagguauuguaaaugacaagauaccaaauacaagauuuua

SEQ ID NO: 759275 - RNA, 60 nt, Homo Sapiens
gccaauuauuaauuugcuaaauaguaauacaaaugacaaacugcauuaaauuuacuaauu

SEQ ID NO: 759276 - RNA, 60 nt, Homo Sapiens
cccccacccuuuuuuccuuaaauaaaguaaaaaugacaccuauuuuauguggcaugaguu

SEQ ID NO: 759277 - RNA, 60 nt, Homo Sapiens
cucacuccacacuggcacguuugugagaagaaaugacauuuugcuaggaagugaccgagu

SEQ ID NO: 759278 - RNA, 60 nt, Homo Sapiens
uuugcaauaaaagguauugagccauuuuuuaaaugacauuuuugauaaauuauguuugua

SEQ ID NO: 759279 - RNA, 60 nt, Homo Sapiens
cucaaauguauugcauaagucuggaagaacaaaugacauguuagaaaaauggggagaaag

SEQ ID NO: 759280 - RNA, 60 nt, Homo Sapiens
uugagaucauuguuguuucacugguggucaaaaugacaugauucagaaaucauauaauag

SEQ ID NO: 759281 - RNA, 60 nt, Homo Sapiens
accuucuaggucuuaaaaucacacauuggaaaaugacaauaucaacaaaacuguauucuu

SEQ ID NO: 759282 - RNA, 60 nt, Homo Sapiens
aaucagcaaaauaauaaaaugaacgaaaaaaaaugacacccagggaguucccaaccccag

SEQ ID NO: 759283 - RNA, 60 nt, Homo Sapiens
ugggaugggaaggaaugggcaaagagauuaaaaugacagaaguuagcuguagaugaccua

SEQ ID NO: 759284 - RNA, 60 nt, Homo Sapiens
ucacuuuugaaauaaaccaucgagaacacaaaaugacaagugaguuagguugggcugaug

SEQ ID NO: 759285 - RNA, 60 nt, Homo Sapiens
uuuuacuagcuaaguagagaaagugagcaaaaaugacaagaaucacaaaugaucauacuu

SEQ ID NO: 759286 - RNA, 60 nt, Homo Sapiens
cuuguuucuccccuuugaauuuuggauacuaaaugacagcagaacauacauguaccaguu

SEQ ID NO: 759287 - RNA, 60 nt, Homo Sapiens
gcucccagcaaccgccacguacaaggucugaaaugacaagggcaagagugagauaggaaa

SEQ ID NO: 759288 - RNA, 60 nt, Homo Sapiens
guauaugccacuauauaaauuuguauuaauaaaugacagucuuguugguuuuuuguuugu

SEQ ID NO: 759289 - RNA, 60 nt, Homo Sapiens
uaaaguugaacuuuguauggcuugaaaaagaaaugacaauauggaacaucccaaggcugu

SEQ ID NO: 759290 - RNA, 60 nt, Homo Sapiens
ugaacugauguuucauuuauauuuucauccaaaugacauuaucugcacguuuuuaaaauu

SEQ ID NO: 759291 - RNA, 60 nt, Homo Sapiens
auaauaaaaguuuuaugaaaacauuuguacaaaugacauggagaauuuaucauuacuguu

SEQ ID NO: 759292 - RNA, 60 nt, Homo Sapiens
guggggaacuggagggugggccaccuugauaaaugacagggggagaccauaaugugucag

SEQ ID NO: 759293 - RNA, 60 nt, Homo Sapiens
auguaauccaucagggauucauuacuuggaaaaugacaggucaugcauuauccaaaaaca

SEQ ID NO: 759294 - RNA, 60 nt, Homo Sapiens
aaaaacaauaccaaaaagacauauuuuauaaaaugacaaaaaauauuuuacauaauuacu

SEQ ID NO: 759295 - RNA, 60 nt, Homo Sapiens
guacuaucaggauuuuacagcaaugcugggaaaugacagggaaaaugacaggaaugaauc

SEQ ID NO: 759296 - RNA, 60 nt, Homo Sapiens
uuuuacagcaaugcugggaaaugacagggaaaaugacaggaaugaaucucaccagauuuu

SEQ ID NO: 759297 - RNA, 60 nt, Homo Sapiens
uacaaauaacaaugaauguuacacaaguauaaaugacaaguaccguuuugucuauaagau

SEQ ID NO: 759298 - RNA, 60 nt, Homo Sapiens
cugguugaagcugguaaucaaaguguaaugaaaugacaagugucucuugacuaauugaca

SEQ ID NO: 759299 - RNA, 60 nt, Homo Sapiens
acuacuguguuaugcaaaagcaagcugauuaaaugacacucauauaauuauauguuguaa

SEQ ID NO: 759300 - RNA, 60 nt, Homo Sapiens
uuaugaagaaggugaauagccauauuuguaaaaugacaaucauguguguuaacccagugc

SEQ ID NO: 759301 - RNA, 60 nt, Homo Sapiens
uuaguuuaucagauugguaauccagauuggaaaugacauuccacuaaaagauuauuuaau

SEQ ID NO: 759302 - RNA, 60 nt, Homo Sapiens
cauugcaucccagucuugugccuuuuggaaaaaugacaaggugacuugguuucucuuugu

SEQ ID NO: 759303 - RNA, 60 nt, Homo Sapiens
ugauauguuuuucugauauaccgguggacaaaaugacaauucauuuccuuacaauacugu

SEQ ID NO: 759304 - RNA, 60 nt, Homo Sapiens
uuaucauguuuuccugcagcuuagagaucuaaaugacauucuagucuaacggucuuguag

SEQ ID NO: 759305 - RNA, 60 nt, Homo Sapiens
aaauaucugcaguuauccagaacagaauggaaaugacaagguauuguucugcaguguuga

SEQ ID NO: 759306 - RNA, 53 nt, Homo Sapiens; identical to SEQ ID NO: 540794

SEQ ID NO: 759307 - RNA, 60 nt, Homo Sapiens
ugacccguuccagguccccugggcucccucaaaugacagaccuaacuauuccuguguaaa

SEQ ID NO: 759308 - RNA, 60 nt, Homo Sapiens
gagauguucgcucgugcaguacuguugguuaaaugacaauuuauguggauuuugcaugua

SEQ ID NO: 759309 - RNA, 60 nt, Homo Sapiens
uguaaaaauuagauuuaaauaguauauuuuaaaugacagaacuauaauuacagagaucag

SEQ ID NO: 759310 - RNA, 60 nt, Homo Sapiens
ugcauaaggcuguugucuucggcuugggugaaaugacaguuccucuucauucuaaagguu

SEQ ID NO: 759311 - RNA, 60 nt, Homo Sapiens
acagacuuauuuucauaaugcaaauuaauaaaaugacacuuuuacugcacuauagaaaua

SEQ ID NO: 759312 - RNA, 60 nt, Homo Sapiens
ucacaccuugaauaagcauaauaccauaaaaaaugacacuugacaugucaauguauuugu

SEQ ID NO: 759313 - RNA, 60 nt, Homo Sapiens
ggaauauguuuaguagauuauaaaacuacuaaaugacacuaguauagugcagauucuaug

SEQ ID NO: 759314 - RNA, 60 nt, Homo Sapiens
gccuucaaaaauauuuuuggugguuuuagcaaaugacagauguacauagagaagaaaauu

SEQ ID NO: 759315 - RNA, 60 nt, Homo Sapiens
aaggaaaguucugcuguuuuguuuugcugaaaaugacauuugaaauaaaggaagauacua

SEQ ID NO: 759316 - RNA, 60 nt, Homo Sapiens
gaaggcuuuaaguauccauuaagauaauagaaaugacacaacuaauucaugguuguucca

SEQ ID NO: 759317 - RNA, 60 nt, Homo Sapiens
ugcaaaaggagaucuaaaaaacacaaucagaaaugacaaaggggacauuaccaccaaccc

SEQ ID NO: 759318 - RNA, 60 nt, Homo Sapiens
aagcuggaagcauuccccuugagaacuggaaaaugacagggaugaccacucucaccacuc

SEQ ID NO: 759319 - RNA, 60 nt, Homo Sapiens
gcuaaagacugcauuauuuuauuuacuucaaaaugacauuaagcaucuacucuuuuuauc

SEQ ID NO: 759320 - RNA, 60 nt, Homo Sapiens
aaucuauauuacuuucucaaaaagccaugcaaaugacaaauguuuuuuuaacuuuacuau

SEQ ID NO: 759321 - RNA, 60 nt, Homo Sapiens
ccauuaauuauauuguuaauucaggguauaaaaugacaucuuuauuuacauuuaaacuug

SEQ ID NO: 759322 - RNA, 60 nt, Homo Sapiens
cauggccggccgggugcuucuccgcccucaaaaugacagcaaccagaaauccaguuauuu

SEQ ID NO: 759323 - RNA, 60 nt, Homo Sapiens
ucaucuuuccuugccuaugacauguguauaaaaugacauugugggagcuguucgauuuuu

SEQ ID NO: 759324 - RNA, 60 nt, Homo Sapiens
gcccauuagccaguuuagcauuuacuuuaaaaaugacaugaggcagauucuuauccagga

SEQ ID NO: 759325 - RNA, 64 nt, Homo Sapiens; identical to SEQ ID NO: 293143

SEQ ID NO: 759326 - RNA, 64 nt, Homo Sapiens; identical to SEQ ID NO: 293144

SEQ ID NO: 759327 - RNA, 64 nt, Homo Sapiens; identical to SEQ ID NO: 293145

SEQ ID NO: 759328 - RNA, 64 nt, Homo Sapiens; identical to SEQ ID NO: 293146

SEQ ID NO: 759329 - RNA, 64 nt, Homo Sapiens; identical to SEQ ID NO: 293147

SEQ ID NO: 759330 - RNA, 64 nt, Homo Sapiens; identical to SEQ ID NO: 293148

SEQ ID NO: 759331 - RNA, 64 nt, Homo Sapiens; identical to SEQ ID NO: 293149

SEQ ID NO: 759332 - RNA, 64 nt, Homo Sapiens; identical to SEQ ID NO: 293150

SEQ ID NO: 759333 - RNA, 64 nt, Homo Sapiens; identical to SEQ ID NO: 293151

SEQ ID NO: 759334 - RNA, 64 nt, Homo Sapiens; identical to SEQ ID NO: 293152

SEQ ID NO: 759335 - RNA, 64 nt, Homo Sapiens; identical to SEQ ID NO: 293153

SEQ ID NO: 759336 - RNA, 64 nt, Homo Sapiens; identical to SEQ ID NO: 293154

SEQ ID NO: 759337 - RNA, 64 nt, Homo Sapiens; identical to SEQ ID NO: 293155

SEQ ID NO: 759338 - RNA, 64 nt, Homo Sapiens; identical to SEQ ID NO: 293156

SEQ ID NO: 759339 - RNA, 64 nt, Homo Sapiens; identical to SEQ ID NO: 293157

SEQ ID NO: 759340 - RNA, 64 nt, Homo Sapiens; identical to SEQ ID NO: 293158

SEQ ID NO: 759341 - RNA, 64 nt, Homo Sapiens; identical to SEQ ID NO: 293159

SEQ ID NO: 759342 - RNA, 64 nt, Homo Sapiens; identical to SEQ ID NO: 293160

SEQ ID NO: 759343 - RNA, 64 nt, Homo Sapiens; identical to SEQ ID NO: 293161

SEQ ID NO: 759344 - RNA, 64 nt, Homo Sapiens; identical to SEQ ID NO: 293162

SEQ ID NO: 759345 - RNA, 64 nt, Homo Sapiens; identical to SEQ ID NO: 293163

SEQ ID NO: 759346 - RNA, 64 nt, Homo Sapiens; identical to SEQ ID NO: 293164

SEQ ID NO: 759347 - RNA, 64 nt, Homo Sapiens; identical to SEQ ID NO: 293165

SEQ ID NO: 759348 - RNA, 64 nt, Homo Sapiens; identical to SEQ ID NO: 293166

SEQ ID NO: 759349 - RNA, 64 nt, Homo Sapiens; identical to SEQ ID NO: 293167

SEQ ID NO: 759350 - RNA, 64 nt, Homo Sapiens; identical to SEQ ID NO: 293168

SEQ ID NO: 759351 - RNA, 64 nt, Homo Sapiens; identical to SEQ ID NO: 293169

SEQ ID NO: 759352 - RNA, 64 nt, Homo Sapiens; identical to SEQ ID NO: 293170

SEQ ID NO: 759353 - RNA, 64 nt, Homo Sapiens; identical to SEQ ID NO: 293171

SEQ ID NO: 759354 - RNA, 64 nt, Homo Sapiens; identical to SEQ ID NO: 293172

SEQ ID NO: 759355 - RNA, 64 nt, Homo Sapiens; identical to SEQ ID NO: 293173

SEQ ID NO: 759356 - RNA, 64 nt, Homo Sapiens; identical to SEQ ID NO: 293174

SEQ ID NO: 759357 - RNA, 64 nt, Homo Sapiens; identical to SEQ ID NO: 293175

SEQ ID NO: 759358 - RNA, 64 nt, Homo Sapiens; identical to SEQ ID NO: 293176

SEQ ID NO: 759359 - RNA, 64 nt, Homo Sapiens; identical to SEQ ID NO: 293177

SEQ ID NO: 759360 - RNA, 64 nt, Homo Sapiens; identical to SEQ ID NO: 293178

SEQ ID NO: 759361 - RNA, 63 nt, Homo Sapiens; identical to SEQ ID NO: 293179

SEQ ID NO: 759362 - RNA, 64 nt, Homo Sapiens; identical to SEQ ID NO: 293180

SEQ ID NO: 759363 - RNA, 64 nt, Homo Sapiens; identical to SEQ ID NO: 293181

SEQ ID NO: 759364 - RNA, 64 nt, Homo Sapiens; identical to SEQ ID NO: 293182

SEQ ID NO: 759365 - RNA, 64 nt, Homo Sapiens; identical to SEQ ID NO: 293183

SEQ ID NO: 759366 - RNA, 64 nt, Homo Sapiens; identical to SEQ ID NO: 293184

SEQ ID NO: 759367 - RNA, 64 nt, Homo Sapiens; identical to SEQ ID NO: 293185

SEQ ID NO: 759368 - RNA, 64 nt, Homo Sapiens; identical to SEQ ID NO: 293186

SEQ ID NO: 759369 - RNA, 64 nt, Homo Sapiens; identical to SEQ ID NO: 293187

SEQ ID NO: 759370 - RNA, 64 nt, Homo Sapiens; identical to SEQ ID NO: 293188

SEQ ID NO: 759371 - RNA, 64 nt, Homo Sapiens; identical to SEQ ID NO: 293189

SEQ ID NO: 759372 - RNA, 64 nt, Homo Sapiens; identical to SEQ ID NO: 293190

SEQ ID NO: 759373 - RNA, 64 nt, Homo Sapiens; identical to SEQ ID NO: 293191

SEQ ID NO: 759374 - RNA, 64 nt, Homo Sapiens; identical to SEQ ID NO: 293192

SEQ ID NO: 759375 - RNA, 64 nt, Homo Sapiens; identical to SEQ ID NO: 293193

SEQ ID NO: 759376 - RNA, 64 nt, Homo Sapiens; identical to SEQ ID NO: 293194

SEQ ID NO: 759377 - RNA, 64 nt, Homo Sapiens; identical to SEQ ID NO: 293195

SEQ ID NO: 759378 - RNA, 53 nt, Homo Sapiens; identical to SEQ ID NO: 293196

SEQ ID NO: 759379 - RNA, 64 nt, Homo Sapiens; identical to SEQ ID NO: 293197

SEQ ID NO: 759380 - RNA, 64 nt, Homo Sapiens; identical to SEQ ID NO: 293198

SEQ ID NO: 759381 - RNA, 64 nt, Homo Sapiens; identical to SEQ ID NO: 293199

SEQ ID NO: 759382 - RNA, 64 nt, Homo Sapiens; identical to SEQ ID NO: 293200

SEQ ID NO: 759383 - RNA, 64 nt, Homo Sapiens; identical to SEQ ID NO: 293201

SEQ ID NO: 759384 - RNA, 64 nt, Homo Sapiens; identical to SEQ ID NO: 293202

SEQ ID NO: 759385 - RNA, 64 nt, Homo Sapiens; identical to SEQ ID NO: 293203

SEQ ID NO: 759386 - RNA, 64 nt, Homo Sapiens; identical to SEQ ID NO: 293204

SEQ ID NO: 759387 - RNA, 64 nt, Homo Sapiens; identical to SEQ ID NO: 293205

SEQ ID NO: 759388 - RNA, 64 nt, Homo Sapiens; identical to SEQ ID NO: 293206

SEQ ID NO: 759389 - RNA, 64 nt, Homo Sapiens; identical to SEQ ID NO: 293207

SEQ ID NO: 759390 - RNA, 64 nt, Homo Sapiens; identical to SEQ ID NO: 293208

SEQ ID NO: 759391 - RNA, 64 nt, Homo Sapiens; identical to SEQ ID NO: 293209

SEQ ID NO: 759392 - RNA, 64 nt, Homo Sapiens; identical to SEQ ID NO: 293210

SEQ ID NO: 759393 - RNA, 64 nt, Homo Sapiens; identical to SEQ ID NO: 293211

SEQ ID NO: 759394 - RNA, 64 nt, Homo Sapiens; identical to SEQ ID NO: 293212

SEQ ID NO: 759395 - RNA, 64 nt, Homo Sapiens; identical to SEQ ID NO: 293213

SEQ ID NO: 759396 - RNA, 64 nt, Homo Sapiens; identical to SEQ ID NO: 293214

SEQ ID NO: 759397 - RNA, 64 nt, Homo Sapiens; identical to SEQ ID NO: 293215

SEQ ID NO: 759398 - RNA, 64 nt, Homo Sapiens; identical to SEQ ID NO: 293216

SEQ ID NO: 759399 - RNA, 64 nt, Homo Sapiens; identical to SEQ ID NO: 293217

SEQ ID NO: 759400 - RNA, 64 nt, Homo Sapiens; identical to SEQ ID NO: 293218

SEQ ID NO: 759401 - RNA, 64 nt, Homo Sapiens; identical to SEQ ID NO: 293219

SEQ ID NO: 759402 - RNA, 64 nt, Homo Sapiens; identical to SEQ ID NO: 293220

SEQ ID NO: 759403 - RNA, 64 nt, Homo Sapiens; identical to SEQ ID NO: 293221

SEQ ID NO: 759404 - RNA, 64 nt, Homo Sapiens; identical to SEQ ID NO: 293222

SEQ ID NO: 759405 - RNA, 64 nt, Homo Sapiens; identical to SEQ ID NO: 293223

SEQ ID NO: 759406 - RNA, 64 nt, Homo Sapiens; identical to SEQ ID NO: 293224

SEQ ID NO: 759407 - RNA, 64 nt, Homo Sapiens; identical to SEQ ID NO: 293225

SEQ ID NO: 759408 - RNA, 64 nt, Homo Sapiens; identical to SEQ ID NO: 293226

SEQ ID NO: 759409 - RNA, 64 nt, Homo Sapiens; identical to SEQ ID NO: 293227

SEQ ID NO: 759410 - RNA, 64 nt, Homo Sapiens; identical to SEQ ID NO: 293228

SEQ ID NO: 759411 - RNA, 64 nt, Homo Sapiens; identical to SEQ ID NO: 293229

SEQ ID NO: 759412 - RNA, 64 nt, Homo Sapiens; identical to SEQ ID NO: 293230

SEQ ID NO: 759413 - RNA, 64 nt, Homo Sapiens; identical to SEQ ID NO: 293231

SEQ ID NO: 759414 - RNA, 59 nt, Homo Sapiens; identical to SEQ ID NO: 293232

SEQ ID NO: 759415 - RNA, 64 nt, Homo Sapiens; identical to SEQ ID NO: 293233

SEQ ID NO: 759416 - RNA, 64 nt, Homo Sapiens; identical to SEQ ID NO: 293234

SEQ ID NO: 759417 - RNA, 64 nt, Homo Sapiens; identical to SEQ ID NO: 293235

SEQ ID NO: 759418 - RNA, 64 nt, Homo Sapiens; identical to SEQ ID NO: 293236

SEQ ID NO: 759419 - RNA, 64 nt, Homo Sapiens; identical to SEQ ID NO: 293237

SEQ ID NO: 759420 - RNA, 64 nt, Homo Sapiens; identical to SEQ ID NO: 293238

SEQ ID NO: 759421 - RNA, 64 nt, Homo Sapiens; identical to SEQ ID NO: 293239

SEQ ID NO: 759422 - RNA, 64 nt, Homo Sapiens; identical to SEQ ID NO: 293240

SEQ ID NO: 759423 - RNA, 64 nt, Homo Sapiens; identical to SEQ ID NO: 293241

SEQ ID NO: 759424 - RNA, 64 nt, Homo Sapiens; identical to SEQ ID NO: 293242

SEQ ID NO: 759425 - RNA, 64 nt, Homo Sapiens; identical to SEQ ID NO: 293243

SEQ ID NO: 759426 - RNA, 64 nt, Homo Sapiens; identical to SEQ ID NO: 293244

SEQ ID NO: 759427 - RNA, 64 nt, Homo Sapiens; identical to SEQ ID NO: 293245

SEQ ID NO: 759428 - RNA, 64 nt, Homo Sapiens; identical to SEQ ID NO: 293246

SEQ ID NO: 759429 - RNA, 64 nt, Homo Sapiens; identical to SEQ ID NO: 293247

SEQ ID NO: 759430 - RNA, 64 nt, Homo Sapiens; identical to SEQ ID NO: 293248

SEQ ID NO: 759431 - RNA, 64 nt, Homo Sapiens; identical to SEQ ID NO: 293249

SEQ ID NO: 759432 - RNA, 64 nt, Homo Sapiens; identical to SEQ ID NO: 293250

SEQ ID NO: 759433 - RNA, 64 nt, Homo Sapiens; identical to SEQ ID NO: 293251

SEQ ID NO: 759434 - RNA, 64 nt, Homo Sapiens; identical to SEQ ID NO: 293252

SEQ ID NO: 759435 - RNA, 64 nt, Homo Sapiens; identical to SEQ ID NO: 293253

SEQ ID NO: 759436 - RNA, 64 nt, Homo Sapiens; identical to SEQ ID NO: 293254

SEQ ID NO: 759437 - RNA, 64 nt, Homo Sapiens; identical to SEQ ID NO: 293255

SEQ ID NO: 759438 - RNA, 64 nt, Homo Sapiens; identical to SEQ ID NO: 293256

SEQ ID NO: 759439 - RNA, 64 nt, Homo Sapiens; identical to SEQ ID NO: 293257

SEQ ID NO: 759440 - RNA, 64 nt, Homo Sapiens; identical to SEQ ID NO: 293258

SEQ ID NO: 759441 - RNA, 64 nt, Homo Sapiens; identical to SEQ ID NO: 293259

SEQ ID NO: 759442 - RNA, 64 nt, Homo Sapiens; identical to SEQ ID NO: 293260

SEQ ID NO: 759443 - RNA, 64 nt, Homo Sapiens; identical to SEQ ID NO: 293261

SEQ ID NO: 759444 - RNA, 64 nt, Homo Sapiens; identical to SEQ ID NO: 293262

SEQ ID NO: 759445 - RNA, 64 nt, Homo Sapiens; identical to SEQ ID NO: 293263

SEQ ID NO: 759446 - RNA, 64 nt, Homo Sapiens; identical to SEQ ID NO: 293264

SEQ ID NO: 759447 - RNA, 64 nt, Homo Sapiens; identical to SEQ ID NO: 293265

SEQ ID NO: 759448 - RNA, 64 nt, Homo Sapiens; identical to SEQ ID NO: 293266

SEQ ID NO: 759449 - RNA, 64 nt, Homo Sapiens; identical to SEQ ID NO: 293267

SEQ ID NO: 759450 - RNA, 64 nt, Homo Sapiens; identical to SEQ ID NO: 293268

SEQ ID NO: 759451 - RNA, 64 nt, Homo Sapiens; identical to SEQ ID NO: 293269

SEQ ID NO: 759452 - RNA, 62 nt, Homo Sapiens
guagccagagcuccucuuccgagucguguccaccaagggacagaggcaucauuccugggcca

SEQ ID NO: 759453 - RNA, 62 nt, Homo Sapiens
aagcaagaggagacauuucccccuugaguuggccaagggaaugaggccccgagaagcgucuu

SEQ ID NO: 759454 - RNA, 62 nt, Homo Sapiens
ggcagaacugggccgccucucuagccauaaggccaagggaguacaccccagcagggugucuu

SEQ ID NO: 759455 - RNA, 62 nt, Homo Sapiens
cagccagcgugcaacugcccggggagaccuggccaagggagcagucacgauuccacaaugga

SEQ ID NO: 759456 - RNA, 62 nt, Homo Sapiens
guucacggcuugggacuuggaccuaugucuuuccaagggacugcugcugagcuagaauuccc

SEQ ID NO: 759457 - RNA, 62 nt, Homo Sapiens
agccacguuaggaagagagaacacggaagaguccaagggagcgcgcaccugcucuguagcag

SEQ ID NO: 759458 - RNA, 62 nt, Homo Sapiens
gccucauuuuagaaccaccaacaagcaagcucccaagggauggugcccuguucucuaccaag

SEQ ID NO: 759459 - RNA, 62 nt, Homo Sapiens
aucagggaauuguuuuaagucuuaucaagcagccaagggaugaaagagaagguggguuuuca

SEQ ID NO: 759460 - RNA, 62 nt, Homo Sapiens
ggugggccuggcggccugugcugggcacugcuccaagggacaucucugaccucugcugagug

SEQ ID NO: 759461 - RNA, 62 nt, Homo Sapiens
gaagggccacccugcugcacaaagacucugagccaagggaggcuccuaggggaagggggugc

SEQ ID NO: 759462 - RNA, 62 nt, Homo Sapiens
ugaccagcucugagccaucgagccacucaguuccaagggaugcugggauggcuggccccaca

SEQ ID NO: 759463 - RNA, 62 nt, Homo Sapiens
ccugccugcaaaggcuguuggcccguaggcuaccaagggacauaagcagcugacauaagaca

SEQ ID NO: 759464 - RNA, 64 nt, Homo Sapiens; identical to SEQ ID NO: 670169

SEQ ID NO: 759465 - RNA, 64 nt, Homo Sapiens; identical to SEQ ID NO: 670170

SEQ ID NO: 759466 - RNA, 64 nt, Homo Sapiens; identical to SEQ ID NO: 670171

SEQ ID NO: 759467 - RNA, 64 nt, Homo Sapiens; identical to SEQ ID NO: 670172

SEQ ID NO: 759468 - RNA, 64 nt, Homo Sapiens; identical to SEQ ID NO: 670173

SEQ ID NO: 759469 - RNA, 64 nt, Homo Sapiens; identical to SEQ ID NO: 670174

SEQ ID NO: 759470 - RNA, 64 nt, Homo Sapiens; identical to SEQ ID NO: 670175

SEQ ID NO: 759471 - RNA, 64 nt, Homo Sapiens; identical to SEQ ID NO: 670176

SEQ ID NO: 759472 - RNA, 64 nt, Homo Sapiens; identical to SEQ ID NO: 670177

SEQ ID NO: 759473 - RNA, 64 nt, Homo Sapiens; identical to SEQ ID NO: 670178

SEQ ID NO: 759474 - RNA, 64 nt, Homo Sapiens; identical to SEQ ID NO: 670179

SEQ ID NO: 759475 - RNA, 64 nt, Homo Sapiens; identical to SEQ ID NO: 670180

SEQ ID NO: 759476 - RNA, 64 nt, Homo Sapiens; identical to SEQ ID NO: 670181

SEQ ID NO: 759477 - RNA, 64 nt, Homo Sapiens; identical to SEQ ID NO: 670182

SEQ ID NO: 759478 - RNA, 64 nt, Homo Sapiens; identical to SEQ ID NO: 670183

SEQ ID NO: 759479 - RNA, 64 nt, Homo Sapiens; identical to SEQ ID NO: 670184

SEQ ID NO: 759480 - RNA, 64 nt, Homo Sapiens; identical to SEQ ID NO: 670185

SEQ ID NO: 759481 - RNA, 64 nt, Homo Sapiens; identical to SEQ ID NO: 670186

SEQ ID NO: 759482 - RNA, 64 nt, Homo Sapiens; identical to SEQ ID NO: 670187

SEQ ID NO: 759483 - RNA, 64 nt, Homo Sapiens; identical to SEQ ID NO: 670188

SEQ ID NO: 759484 - RNA, 64 nt, Homo Sapiens; identical to SEQ ID NO: 670189

SEQ ID NO: 759485 - RNA, 64 nt, Homo Sapiens; identical to SEQ ID NO: 670190

SEQ ID NO: 759486 - RNA, 64 nt, Homo Sapiens; identical to SEQ ID NO: 670191

SEQ ID NO: 759487 - RNA, 64 nt, Homo Sapiens; identical to SEQ ID NO: 670192

SEQ ID NO: 759488 - RNA, 64 nt, Homo Sapiens; identical to SEQ ID NO: 670193

SEQ ID NO: 759489 - RNA, 64 nt, Homo Sapiens; identical to SEQ ID NO: 670194

SEQ ID NO: 759490 - RNA, 64 nt, Homo Sapiens; identical to SEQ ID NO: 670195

SEQ ID NO: 759491 - RNA, 64 nt, Homo Sapiens; identical to SEQ ID NO: 670196

SEQ ID NO: 759492 - RNA, 64 nt, Homo Sapiens; identical to SEQ ID NO: 670197

SEQ ID NO: 759493 - RNA, 64 nt, Homo Sapiens; identical to SEQ ID NO: 670198

SEQ ID NO: 759494 - RNA, 64 nt, Homo Sapiens; identical to SEQ ID NO: 670199

SEQ ID NO: 759495 - RNA, 64 nt, Homo Sapiens; identical to SEQ ID NO: 670200

SEQ ID NO: 759496 - RNA, 62 nt, Homo Sapiens
uuuugaaaugugucauuuuuaaacaaucuuaaaaguaauacagaauugugauuuauuaauuu

SEQ ID NO: 759497 - RNA, 62 nt, Homo Sapiens
cuuagaacuuagaaguguuucuaagagaacagaaguaauaagagaaacaguuacguguggaa

SEQ ID NO: 759498 - RNA, 62 nt, Homo Sapiens
ccuguuugaagcuuuaagagauacuuuuccucaaguaauauaauccuuaguacacagagaau

SEQ ID NO: 759499 - RNA, 62 nt, Homo Sapiens
aauuaccucuuuaaaaaguauuauucacucagaaguaauauauaucacagugaaaggcaaaa

SEQ ID NO: 759500 - RNA, 62 nt, Homo Sapiens
uguauuguugagauauauugaauauauuguacaaguaauaaauauguuauuaugugugaagu

SEQ ID NO: 759501 - RNA, 62 nt, Homo Sapiens
uuguacaaguaauaaauguauuauuaugugugaaguaauauauagugaaaugauguuuuaug

SEQ ID NO: 759502 - RNA, 62 nt, Homo Sapiens
cuuauuucuucauuuuaagucauugcaauggaaaguaauauuauaaaaugguaauuacaaca

SEQ ID NO: 759503 - RNA, 62 nt, Homo Sapiens
ugacaacguguuucugaaaaacagauuuucauaaguaauaauaaaaauaauaauaaaaaagu

SEQ ID NO: 759504 - RNA, 62 nt, Homo Sapiens
aaaagucaaagcaguguucucuaauaaauacaaaguaauaacaaaauuaugaauaggauaua

SEQ ID NO: 759505 - RNA, 62 nt, Homo Sapiens
uucuguaugaauaagcauaacaaaauucuagaaaguaauaaaagugauuaugauucuuaucc

SEQ ID NO: 759506 - RNA, 62 nt, Homo Sapiens
aguuccauuuaaauaugagugaaagcuguacaaaguaauagauucuauucaacuucuaauuu

SEQ ID NO: 759507 - RNA, 62 nt, Homo Sapiens
uccccaauaucaucuaaucaauaccauuguaaaaguaauaaucauucuccuaaaaauccgua

SEQ ID NO: 759508 - RNA, 62 nt, Homo Sapiens
agacuggauucuguaccagaacuaaacauaguaaguaauacugauaguaaaaacaccugaca

SEQ ID NO: 759509 - RNA, 62 nt, Homo Sapiens
aaaacuauuucagauguauuugcauugugcccaaguaauaauaggcaggaacgggggaccau

SEQ ID NO: 759510 - RNA, 62 nt, Homo Sapiens
uggggagagcacucgguugucuuuacuuuuaaaaguaauacuuggugcuaagaauuucagga

SEQ ID NO: 759511 - RNA, 62 nt, Homo Sapiens
gagagcaacaggccccugauuauacaguuccaaaguaauaagauguuaauuguaauucagcc

SEQ ID NO: 759512 - RNA, 62 nt, Homo Sapiens
uuuagcuuuagaaagaaaugcguuauagaaacaaguaauagcaagaaaauugauguauauuu

SEQ ID NO: 759513 - RNA, 62 nt, Homo Sapiens
gcauuauugggugccuuuguuuguaaaccaaaaaguaauaaaugaaucccuauauuuccauu

SEQ ID NO: 759514 - RNA, 62 nt, Homo Sapiens
aauacggugguugagaaggaaccaguguuuacaaguaauaucagaaaguugaaggaaccagu

SEQ ID NO: 759515 - RNA, 62 nt, Homo Sapiens
aauaucagaaaguugaaggaaccaguguuuacaaguaauaccagaaaguugccaaacccuuc

SEQ ID NO: 759516 - RNA, 62 nt, Homo Sapiens
uaccaccuaaaacugaauuuuaucauauaagcaaguaauaccuauuagucauaccuaaauuu

SEQ ID NO: 759517 - RNA, 62 nt, Homo Sapiens
caggcuuuaccgguuuuuuuaguuguuuaaauaaguaauauuuucaaaagaauaaaauaacc

SEQ ID NO: 759518 - RNA, 62 nt, Homo Sapiens
acauuucuuccuggacaguuaacauuuuuaggaaguaauaauaaaguaauagcuuuuguuca

SEQ ID NO: 759519 - RNA, 62 nt, Homo Sapiens
uuuuguucaaacauuuuuagauacaucauucaaaguaauagcacagcaauuaccuauggaga

SEQ ID NO: 759520 - RNA, 62 nt, Homo Sapiens
ugccacaugugggaaguaggucauuaauuuugaaguaauaacuaguauaacaugagugaaug

SEQ ID NO: 759521 - RNA, 62 nt, Homo Sapiens
ugugccucagacuuggggguauccacuggcagaaguaauagucuuaaauaugcuuguauagc

SEQ ID NO: 759522 - RNA, 62 nt, Homo Sapiens
aaaugguaauaguuaacauuuuuuguuacaaaaaguaauagauuacaaaaaacucccacuuu

SEQ ID NO: 759523 - RNA, 62 nt, Homo Sapiens
ugaaggagcuaacuacccaaaagcaguaccccaaguaauaaccaccauauuuucgcuagcuc

SEQ ID NO: 759524 - RNA, 62 nt, Homo Sapiens
augugucuaccaagaacaauugaguuuucuaaaaguaauaaugaagauuaugcaauucuaac

SEQ ID NO: 759525 - RNA, 62 nt, Homo Sapiens
uaaucuuuuuaaauuguacagcaaggugcucuaaguaauauucgauaaaauauauuuaauag

SEQ ID NO: 759526 - RNA, 64 nt, Homo Sapiens
uuccugucuugacccaauuuaugagaaagcucccaguugggacuuuaucucacaaguggaauca

SEQ ID NO: 759527 - RNA, 64 nt, Homo Sapiens
aggaccacuuguuguacaucugaauaauuauggaaguugggacauguuaaggaaaacaaauaug

SEQ ID NO: 759528 - RNA, 64 nt, Homo Sapiens
cugggugggagggaaacuucauuucacuggaaugaguugggagagaaaggcccucagcuuuuag

SEQ ID NO: 759529 - RNA, 64 nt, Homo Sapiens
cucccaccucagacucccaaagugcuggaauuacaguugggagccacugugccuggccuggaag

SEQ ID NO: 759530 - RNA, 64 nt, Homo Sapiens
cagauccaaguuugacuccaacacuauauguuggaguugggaauacauuggggguaaauaacag

SEQ ID NO: 759531 - RNA, 64 nt, Homo Sapiens
auuauuauguaaaauaauaauauuccauaaaaguaguugggaaaaaauuuucuuucuuuugagg

SEQ ID NO: 759532 - RNA, 64 nt, Homo Sapiens
cuuugggguggggagggagggaggagggagguggaguugggauggaguauggaugucuuuuuuu

SEQ ID NO: 759533 - RNA, 64 nt, Homo Sapiens
auaauacaaauucaguuugucagguuggauggugaguugggagcugugauggaucuguuggcgg

SEQ ID NO: 759534 - RNA, 64 nt, Homo Sapiens
ucaacuucagaaggccucacucaagccugagagaaguugggagggugguggggacagguaagug

SEQ ID NO: 759535 - RNA, 64 nt, Homo Sapiens
augacagaaugagcagucccuaaugguauugggcaguugggagugaguuuaggcagcuucucug

SEQ ID NO: 759536 - RNA, 64 nt, Homo Sapiens
acugggaccugaaugaccugcagucagggcccagaguugggacucuauacuacccugggcucug

SEQ ID NO: 759537 - RNA, 64 nt, Homo Sapiens
accaucucccugcugcagguuuagaggaccagugaguugggaguuauuacucaaguggcaccua

SEQ ID NO: 759538 - RNA, 64 nt, Homo Sapiens
guaauugcaaguucauaaagagaauugaggguccaguugggagaacuauuagucaguucuuuua

SEQ ID NO: 759539 - RNA, 64 nt, Homo Sapiens
caggauauuaguuaaugagccaagguauuucuccaguugggacuaaggugguauguaauuuaug

SEQ ID NO: 759540 - RNA, 64 nt, Homo Sapiens
caaaacacaggaagucaguccaauucaccaacacaguugggacccgucucuauaccaaccaaac

SEQ ID NO: 759541 - RNA, 64 nt, Homo Sapiens
cugcuucuccccgaggagguugagcucuugagcaaguugggacuugggccggggccuggaagaa

SEQ ID NO: 759542 - RNA, 64 nt, Homo Sapiens
gaggccgcgggagggaggccaggaggcccggaccaguugggaggagugagcaggccccggggga

SEQ ID NO: 759543 - RNA, 64 nt, Homo Sapiens
gacagaugaacuuuugcauguguauauaagaaugaguugggaccucugucuuuaaaaaucuauu

SEQ ID NO: 759544 - RNA, 64 nt, Homo Sapiens
ucugacuucacauguuaauagaggaucagagcagaguugggaguauauuggucaggaucauaga

SEQ ID NO: 759545 - RNA, 64 nt, Homo Sapiens; identical to SEQ ID NO: 334267

SEQ ID NO: 759546 - RNA, 64 nt, Homo Sapiens; identical to SEQ ID NO: 334268

SEQ ID NO: 759547 - RNA, 64 nt, Homo Sapiens; identical to SEQ ID NO: 334269

SEQ ID NO: 759548 - RNA, 64 nt, Homo Sapiens; identical to SEQ ID NO: 334270

SEQ ID NO: 759549 - RNA, 64 nt, Homo Sapiens; identical to SEQ ID NO: 334271

SEQ ID NO: 759550 - RNA, 64 nt, Homo Sapiens; identical to SEQ ID NO: 334272

SEQ ID NO: 759551 - RNA, 64 nt, Homo Sapiens; identical to SEQ ID NO: 334273

SEQ ID NO: 759552 - RNA, 64 nt, Homo Sapiens; identical to SEQ ID NO: 334274

SEQ ID NO: 759553 - RNA, 64 nt, Homo Sapiens; identical to SEQ ID NO: 334275

SEQ ID NO: 759554 - RNA, 64 nt, Homo Sapiens; identical to SEQ ID NO: 334276

SEQ ID NO: 759555 - RNA, 64 nt, Homo Sapiens; identical to SEQ ID NO: 545831

SEQ ID NO: 759556 - RNA, 64 nt, Homo Sapiens; identical to SEQ ID NO: 545832

SEQ ID NO: 759557 - RNA, 64 nt, Homo Sapiens; identical to SEQ ID NO: 545833

SEQ ID NO: 759558 - RNA, 64 nt, Homo Sapiens; identical to SEQ ID NO: 545834

SEQ ID NO: 759559 - RNA, 64 nt, Homo Sapiens; identical to SEQ ID NO: 545835

SEQ ID NO: 759560 - RNA, 64 nt, Homo Sapiens; identical to SEQ ID NO: 545836

SEQ ID NO: 759561 - RNA, 64 nt, Homo Sapiens; identical to SEQ ID NO: 545837

SEQ ID NO: 759562 - RNA, 64 nt, Homo Sapiens; identical to SEQ ID NO: 545838

SEQ ID NO: 759563 - RNA, 64 nt, Homo Sapiens; identical to SEQ ID NO: 545839

SEQ ID NO: 759564 - RNA, 64 nt, Homo Sapiens; identical to SEQ ID NO: 545840

SEQ ID NO: 759565 - RNA, 64 nt, Homo Sapiens; identical to SEQ ID NO: 545841

SEQ ID NO: 759566 - RNA, 64 nt, Homo Sapiens; identical to SEQ ID NO: 545842

SEQ ID NO: 759567 - RNA, 64 nt, Homo Sapiens; identical to SEQ ID NO: 545843

SEQ ID NO: 759568 - RNA, 64 nt, Homo Sapiens; identical to SEQ ID NO: 545844

SEQ ID NO: 759569 - RNA, 64 nt, Homo Sapiens; identical to SEQ ID NO: 545845

SEQ ID NO: 759570 - RNA, 64 nt, Homo Sapiens; identical to SEQ ID NO: 545846

SEQ ID NO: 759571 - RNA, 64 nt, Homo Sapiens; identical to SEQ ID NO: 545847

SEQ ID NO: 759572 - RNA, 64 nt, Homo Sapiens; identical to SEQ ID NO: 545848

SEQ ID NO: 759573 - RNA, 64 nt, Homo Sapiens; identical to SEQ ID NO: 545849

SEQ ID NO: 759574 - RNA, 64 nt, Homo Sapiens; identical to SEQ ID NO: 545850

SEQ ID NO: 759575 - RNA, 64 nt, Homo Sapiens; identical to SEQ ID NO: 545851

SEQ ID NO: 759576 - RNA, 64 nt, Homo Sapiens; identical to SEQ ID NO: 545852

SEQ ID NO: 759577 - RNA, 64 nt, Homo Sapiens; identical to SEQ ID NO: 545853

SEQ ID NO: 759578 - RNA, 64 nt, Homo Sapiens; identical to SEQ ID NO: 545854

SEQ ID NO: 759579 - RNA, 64 nt, Homo Sapiens; identical to SEQ ID NO: 545855

SEQ ID NO: 759580 - RNA, 64 nt, Homo Sapiens; identical to SEQ ID NO: 545856

SEQ ID NO: 759581 - RNA, 64 nt, Homo Sapiens; identical to SEQ ID NO: 545857

SEQ ID NO: 759582 - RNA, 64 nt, Homo Sapiens; identical to SEQ ID NO: 545858

SEQ ID NO: 759583 - RNA, 64 nt, Homo Sapiens; identical to SEQ ID NO: 545859

SEQ ID NO: 759584 - RNA, 64 nt, Homo Sapiens; identical to SEQ ID NO: 545860

SEQ ID NO: 759585 - RNA, 64 nt, Homo Sapiens; identical to SEQ ID NO: 545861

SEQ ID NO: 759586 - RNA, 64 nt, Homo Sapiens; identical to SEQ ID NO: 545862

SEQ ID NO: 759587 - RNA, 64 nt, Homo Sapiens; identical to SEQ ID NO: 545863

SEQ ID NO: 759588 - RNA, 64 nt, Homo Sapiens; identical to SEQ ID NO: 545864

SEQ ID NO: 759589 - RNA, 64 nt, Homo Sapiens; identical to SEQ ID NO: 421584

SEQ ID NO: 759590 - RNA, 64 nt, Homo Sapiens; identical to SEQ ID NO: 421585

SEQ ID NO: 759591 - RNA, 64 nt, Homo Sapiens; identical to SEQ ID NO: 421586

SEQ ID NO: 759592 - RNA, 64 nt, Homo Sapiens; identical to SEQ ID NO: 421587

SEQ ID NO: 759593 - RNA, 64 nt, Homo Sapiens; identical to SEQ ID NO: 421588

SEQ ID NO: 759594 - RNA, 64 nt, Homo Sapiens; identical to SEQ ID NO: 421589

SEQ ID NO: 759595 - RNA, 51 nt, Homo Sapiens; identical to SEQ ID NO: 421590

SEQ ID NO: 759596 - RNA, 64 nt, Homo Sapiens; identical to SEQ ID NO: 421591

SEQ ID NO: 759597 - RNA, 64 nt, Homo Sapiens; identical to SEQ ID NO: 421592

SEQ ID NO: 759598 - RNA, 64 nt, Homo Sapiens; identical to SEQ ID NO: 421593

SEQ ID NO: 759599 - RNA, 64 nt, Homo Sapiens; identical to SEQ ID NO: 421594

SEQ ID NO: 759600 - RNA, 64 nt, Homo Sapiens; identical to SEQ ID NO: 421595

SEQ ID NO: 759601 - RNA, 64 nt, Homo Sapiens; identical to SEQ ID NO: 421596

SEQ ID NO: 759602 - RNA, 64 nt, Homo Sapiens; identical to SEQ ID NO: 421597

SEQ ID NO: 759603 - RNA, 64 nt, Homo Sapiens; identical to SEQ ID NO: 421598

SEQ ID NO: 759604 - RNA, 64 nt, Homo Sapiens; identical to SEQ ID NO: 421599

SEQ ID NO: 759605 - RNA, 64 nt, Homo Sapiens; identical to SEQ ID NO: 421600

SEQ ID NO: 759606 - RNA, 64 nt, Homo Sapiens; identical to SEQ ID NO: 421601

SEQ ID NO: 759607 - RNA, 64 nt, Homo Sapiens; identical to SEQ ID NO: 421602

SEQ ID NO: 759608 - RNA, 64 nt, Homo Sapiens; identical to SEQ ID NO: 421603

SEQ ID NO: 759609 - RNA, 64 nt, Homo Sapiens; identical to SEQ ID NO: 421604

SEQ ID NO: 759610 - RNA, 64 nt, Homo Sapiens; identical to SEQ ID NO: 421605

SEQ ID NO: 759611 - RNA, 64 nt, Homo Sapiens; identical to SEQ ID NO: 421606

SEQ ID NO: 759612 - RNA, 64 nt, Homo Sapiens; identical to SEQ ID NO: 421607

SEQ ID NO: 759613 - RNA, 64 nt, Homo Sapiens; identical to SEQ ID NO: 421608

SEQ ID NO: 759614 - RNA, 64 nt, Homo Sapiens; identical to SEQ ID NO: 421609

SEQ ID NO: 759615 - RNA, 64 nt, Homo Sapiens; identical to SEQ ID NO: 421610

SEQ ID NO: 759616 - RNA, 64 nt, Homo Sapiens; identical to SEQ ID NO: 421611

SEQ ID NO: 759617 - RNA, 64 nt, Homo Sapiens; identical to SEQ ID NO: 421612

SEQ ID NO: 759618 - RNA, 64 nt, Homo Sapiens; identical to SEQ ID NO: 421613

SEQ ID NO: 759619 - RNA, 64 nt, Homo Sapiens; identical to SEQ ID NO: 421614

SEQ ID NO: 759620 - RNA, 64 nt, Homo Sapiens; identical to SEQ ID NO: 421615

SEQ ID NO: 759621 - RNA, 64 nt, Homo Sapiens; identical to SEQ ID NO: 421616

SEQ ID NO: 759622 - RNA, 64 nt, Homo Sapiens; identical to SEQ ID NO: 421617

SEQ ID NO: 759623 - RNA, 64 nt, Homo Sapiens; identical to SEQ ID NO: 421618

SEQ ID NO: 759624 - RNA, 64 nt, Homo Sapiens; identical to SEQ ID NO: 421619

SEQ ID NO: 759625 - RNA, 64 nt, Homo Sapiens; identical to SEQ ID NO: 421620

SEQ ID NO: 759626 - RNA, 64 nt, Homo Sapiens; identical to SEQ ID NO: 421621

SEQ ID NO: 759627 - RNA, 64 nt, Homo Sapiens; identical to SEQ ID NO: 421622

SEQ ID NO: 759628 - RNA, 64 nt, Homo Sapiens; identical to SEQ ID NO: 484813

SEQ ID NO: 759629 - RNA, 64 nt, Homo Sapiens; identical to SEQ ID NO: 484814

SEQ ID NO: 759630 - RNA, 64 nt, Homo Sapiens; identical to SEQ ID NO: 484815

SEQ ID NO: 759631 - RNA, 64 nt, Homo Sapiens; identical to SEQ ID NO: 484816

SEQ ID NO: 759632 - RNA, 64 nt, Homo Sapiens; identical to SEQ ID NO: 484817

SEQ ID NO: 759633 - RNA, 64 nt, Homo Sapiens; identical to SEQ ID NO: 484818

SEQ ID NO: 759634 - RNA, 64 nt, Homo Sapiens; identical to SEQ ID NO: 484819

SEQ ID NO: 759635 - RNA, 64 nt, Homo Sapiens; identical to SEQ ID NO: 484820

SEQ ID NO: 759636 - RNA, 64 nt, Homo Sapiens; identical to SEQ ID NO: 484821

SEQ ID NO: 759637 - RNA, 64 nt, Homo Sapiens; identical to SEQ ID NO: 484822

SEQ ID NO: 759638 - RNA, 64 nt, Homo Sapiens; identical to SEQ ID NO: 484823

SEQ ID NO: 759639 - RNA, 64 nt, Homo Sapiens; identical to SEQ ID NO: 484824

SEQ ID NO: 759640 - RNA, 64 nt, Homo Sapiens; identical to SEQ ID NO: 484825

SEQ ID NO: 759641 - RNA, 64 nt, Homo Sapiens; identical to SEQ ID NO: 484826

SEQ ID NO: 759642 - RNA, 60 nt, Homo Sapiens; identical to SEQ ID NO: 395328

SEQ ID NO: 759643 - RNA, 60 nt, Homo Sapiens; identical to SEQ ID NO: 395329

SEQ ID NO: 759644 - RNA, 60 nt, Homo Sapiens; identical to SEQ ID NO: 395330

SEQ ID NO: 759645 - RNA, 60 nt, Homo Sapiens; identical to SEQ ID NO: 395331

SEQ ID NO: 759646 - RNA, 60 nt, Homo Sapiens; identical to SEQ ID NO: 395332

SEQ ID NO: 759647 - RNA, 60 nt, Homo Sapiens; identical to SEQ ID NO: 395333

SEQ ID NO: 759648 - RNA, 60 nt, Homo Sapiens; identical to SEQ ID NO: 395334

SEQ ID NO: 759649 - RNA, 60 nt, Homo Sapiens; identical to SEQ ID NO: 395335

SEQ ID NO: 759650 - RNA, 60 nt, Homo Sapiens; identical to SEQ ID NO: 395336

SEQ ID NO: 759651 - RNA, 60 nt, Homo Sapiens; identical to SEQ ID NO: 395337

SEQ ID NO: 759652 - RNA, 60 nt, Homo Sapiens; identical to SEQ ID NO: 395338

SEQ ID NO: 759653 - RNA, 60 nt, Homo Sapiens; identical to SEQ ID NO: 395339

SEQ ID NO: 759654 - RNA, 60 nt, Homo Sapiens; identical to SEQ ID NO: 395340

SEQ ID NO: 759655 - RNA, 60 nt, Homo Sapiens; identical to SEQ ID NO: 395341

SEQ ID NO: 759656 - RNA, 60 nt, Homo Sapiens; identical to SEQ ID NO: 395342

SEQ ID NO: 759657 - RNA, 60 nt, Homo Sapiens; identical to SEQ ID NO: 395343

SEQ ID NO: 759658 - RNA, 60 nt, Homo Sapiens; identical to SEQ ID NO: 395344

SEQ ID NO: 759659 - RNA, 60 nt, Homo Sapiens; identical to SEQ ID NO: 395345

SEQ ID NO: 759660 - RNA, 60 nt, Homo Sapiens; identical to SEQ ID NO: 395346

SEQ ID NO: 759661 - RNA, 60 nt, Homo Sapiens; identical to SEQ ID NO: 395347

SEQ ID NO: 759662 - RNA, 60 nt, Homo Sapiens; identical to SEQ ID NO: 395348

SEQ ID NO: 759663 - RNA, 60 nt, Homo Sapiens; identical to SEQ ID NO: 395349

SEQ ID NO: 759664 - RNA, 60 nt, Homo Sapiens; identical to SEQ ID NO: 395350

SEQ ID NO: 759665 - RNA, 60 nt, Homo Sapiens; identical to SEQ ID NO: 395351

SEQ ID NO: 759666 - RNA, 60 nt, Homo Sapiens; identical to SEQ ID NO: 395352

SEQ ID NO: 759667 - RNA, 60 nt, Homo Sapiens; identical to SEQ ID NO: 395353

SEQ ID NO: 759668 - RNA, 64 nt, Homo Sapiens; identical to SEQ ID NO: 39289

SEQ ID NO: 759669 - RNA, 64 nt, Homo Sapiens; identical to SEQ ID NO: 39290

SEQ ID NO: 759670 - RNA, 64 nt, Homo Sapiens; identical to SEQ ID NO: 39291

SEQ ID NO: 759671 - RNA, 64 nt, Homo Sapiens; identical to SEQ ID NO: 39292

SEQ ID NO: 759672 - RNA, 64 nt, Homo Sapiens; identical to SEQ ID NO: 39293

SEQ ID NO: 759673 - RNA, 64 nt, Homo Sapiens; identical to SEQ ID NO: 39294

SEQ ID NO: 759674 - RNA, 64 nt, Homo Sapiens; identical to SEQ ID NO: 39295

SEQ ID NO: 759675 - RNA, 64 nt, Homo Sapiens; identical to SEQ ID NO: 39296

SEQ ID NO: 759676 - RNA, 64 nt, Homo Sapiens; identical to SEQ ID NO: 39297

SEQ ID NO: 759677 - RNA, 64 nt, Homo Sapiens; identical to SEQ ID NO: 39298

SEQ ID NO: 759678 - RNA, 64 nt, Homo Sapiens; identical to SEQ ID NO: 39299

SEQ ID NO: 759679 - RNA, 64 nt, Homo Sapiens; identical to SEQ ID NO: 39300

SEQ ID NO: 759680 - RNA, 64 nt, Homo Sapiens; identical to SEQ ID NO: 39301

SEQ ID NO: 759681 - RNA, 64 nt, Homo Sapiens; identical to SEQ ID NO: 39302

SEQ ID NO: 759682 - RNA, 64 nt, Homo Sapiens; identical to SEQ ID NO: 39303

SEQ ID NO: 759683 - RNA, 64 nt, Homo Sapiens; identical to SEQ ID NO: 39304

SEQ ID NO: 759684 - RNA, 64 nt, Homo Sapiens; identical to SEQ ID NO: 39305

SEQ ID NO: 759685 - RNA, 64 nt, Homo Sapiens; identical to SEQ ID NO: 39306

SEQ ID NO: 759686 - RNA, 64 nt, Homo Sapiens; identical to SEQ ID NO: 39307

SEQ ID NO: 759687 - RNA, 64 nt, Homo Sapiens; identical to SEQ ID NO: 39308

SEQ ID NO: 759688 - RNA, 64 nt, Homo Sapiens; identical to SEQ ID NO: 39309

SEQ ID NO: 759689 - RNA, 64 nt, Homo Sapiens; identical to SEQ ID NO: 39310

SEQ ID NO: 759690 - RNA, 64 nt, Homo Sapiens; identical to SEQ ID NO: 39311

SEQ ID NO: 759691 - RNA, 64 nt, Homo Sapiens; identical to SEQ ID NO: 39312

SEQ ID NO: 759692 - RNA, 64 nt, Homo Sapiens; identical to SEQ ID NO: 39313

SEQ ID NO: 759693 - RNA, 64 nt, Homo Sapiens; identical to SEQ ID NO: 39314

SEQ ID NO: 759694 - RNA, 64 nt, Homo Sapiens; identical to SEQ ID NO: 39315

SEQ ID NO: 759695 - RNA, 64 nt, Homo Sapiens; identical to SEQ ID NO: 39316

SEQ ID NO: 759696 - RNA, 64 nt, Homo Sapiens; identical to SEQ ID NO: 39317

SEQ ID NO: 759697 - RNA, 64 nt, Homo Sapiens; identical to SEQ ID NO: 39318

SEQ ID NO: 759698 - RNA, 64 nt, Homo Sapiens; identical to SEQ ID NO: 39319

SEQ ID NO: 759699 - RNA, 64 nt, Homo Sapiens; identical to SEQ ID NO: 39320

SEQ ID NO: 759700 - RNA, 64 nt, Homo Sapiens; identical to SEQ ID NO: 39321

SEQ ID NO: 759701 - RNA, 64 nt, Homo Sapiens; identical to SEQ ID NO: 39322

SEQ ID NO: 759702 - RNA, 64 nt, Homo Sapiens; identical to SEQ ID NO: 39323

SEQ ID NO: 759703 - RNA, 64 nt, Homo Sapiens; identical to SEQ ID NO: 39324

SEQ ID NO: 759704 - RNA, 64 nt, Homo Sapiens; identical to SEQ ID NO: 39325

SEQ ID NO: 759705 - RNA, 64 nt, Homo Sapiens; identical to SEQ ID NO: 39326

SEQ ID NO: 759706 - RNA, 64 nt, Homo Sapiens; identical to SEQ ID NO: 39327

SEQ ID NO: 759707 - RNA, 64 nt, Homo Sapiens; identical to SEQ ID NO: 39328

SEQ ID NO: 759708 - RNA, 64 nt, Homo Sapiens; identical to SEQ ID NO: 39329

SEQ ID NO: 759709 - RNA, 64 nt, Homo Sapiens; identical to SEQ ID NO: 39330

SEQ ID NO: 759710 - RNA, 64 nt, Homo Sapiens; identical to SEQ ID NO: 39331

SEQ ID NO: 759711 - RNA, 64 nt, Homo Sapiens; identical to SEQ ID NO: 39332

SEQ ID NO: 759712 - RNA, 61 nt, Homo Sapiens; identical to SEQ ID NO: 39333

SEQ ID NO: 759713 - RNA, 64 nt, Homo Sapiens; identical to SEQ ID NO: 39334

SEQ ID NO: 759714 - RNA, 64 nt, Homo Sapiens; identical to SEQ ID NO: 39335

SEQ ID NO: 759715 - RNA, 64 nt, Homo Sapiens; identical to SEQ ID NO: 39336

SEQ ID NO: 759716 - RNA, 64 nt, Homo Sapiens; identical to SEQ ID NO: 39337

SEQ ID NO: 759717 - RNA, 64 nt, Homo Sapiens; identical to SEQ ID NO: 39338

SEQ ID NO: 759718 - RNA, 64 nt, Homo Sapiens; identical to SEQ ID NO: 39339

SEQ ID NO: 759719 - RNA, 64 nt, Homo Sapiens; identical to SEQ ID NO: 39340

SEQ ID NO: 759720 - RNA, 64 nt, Homo Sapiens; identical to SEQ ID NO: 39341

SEQ ID NO: 759721 - RNA, 64 nt, Homo Sapiens; identical to SEQ ID NO: 39342

SEQ ID NO: 759722 - RNA, 64 nt, Homo Sapiens; identical to SEQ ID NO: 39343

SEQ ID NO: 759723 - RNA, 64 nt, Homo Sapiens; identical to SEQ ID NO: 39344

SEQ ID NO: 759724 - RNA, 64 nt, Homo Sapiens; identical to SEQ ID NO: 39345

SEQ ID NO: 759725 - RNA, 64 nt, Homo Sapiens; identical to SEQ ID NO: 39346

SEQ ID NO: 759726 - RNA, 62 nt, Homo Sapiens
uuugaauuauuucuaagccuacuacuugggccucuuucuagucaagagccauagguagccuu

SEQ ID NO: 759727 - RNA, 62 nt, Homo Sapiens
cacacacacaucagacuggcauuuucuaucauucuuucuagacuugaacucaagaacucuuu

SEQ ID NO: 759728 - RNA, 62 nt, Homo Sapiens
ccccagacuuuggccucugagucaagcuuccuucuuucuaacguaaaugaaacuuuguuugg

SEQ ID NO: 759729 - RNA, 62 nt, Homo Sapiens
ccucccucuugggcaugggccauuugcuuggcucuuucuacagcuguccucuuucuccacuc

SEQ ID NO: 759730 - RNA, 62 nt, Homo Sapiens
acaaggaaauagauaaacuggacuauaccguaucuuucuagcacccagucacugcauuuuug

SEQ ID NO: 759731 - RNA, 62 nt, Homo Sapiens
aucagguaccugcuuucauuuuuuuuauuguuucuuucuauggaagaacuauugaugcaagu

SEQ ID NO: 759732 - RNA, 62 nt, Homo Sapiens
uugaggauguugaaauguauuacauuuuggcuucuuucuacauguuaacugcacuguagaug

SEQ ID NO: 759733 - RNA, 62 nt, Homo Sapiens
uaccuuaaauuggaagacuuuuaauugcagucucuuucuaccuucccucuguuagucauuug

SEQ ID NO: 759734 - RNA, 62 nt, Homo Sapiens
cagauaggccauugcuuucaggcgaagugacaucuuucuaacuguuugaaaggaugcuauca

SEQ ID NO: 759735 - RNA, 62 nt, Homo Sapiens
guaaaauggcgccuuuaaaagcccacuuguauucuuucuacuggccagugccugucccccag

SEQ ID NO: 759736 - RNA, 62 nt, Homo Sapiens
aagguauuauguaaaaauauuuaauaauuuauucuuucuauuacugaauuaaaaaaucagag

SEQ ID NO: 759737 - RNA, 62 nt, Homo Sapiens
uauuucuugcuuauuauauguaaaguugagcuucuuucuagauauuaggccuuugaauaaaa

SEQ ID NO: 759738 - RNA, 62 nt, Homo Sapiens
ggauuaggagccauaccucccagagcaagguaucuuucuagagcaaauuucucuuucuagaa

SEQ ID NO: 759739 - RNA, 62 nt, Homo Sapiens
ccagagcaagguaucuuucuagagcaaauuucucuuucuagaaggggagggucacaggguca

SEQ ID NO: 759740 - RNA, 62 nt, Homo Sapiens
ucacuacacaaaccaggcacucucccuuucugucuuucuaguuuccuuuccuugucucucuc

SEQ ID NO: 759741 - RNA, 62 nt, Homo Sapiens
uguccacaccuaauaagugcaaucauuuugagucuuucuauguugucuagacggagggguuu

SEQ ID NO: 759742 - RNA, 62 nt, Homo Sapiens
gcauucuuucuuaugaauuguauauuuagaaaucuuucuaaauaccauuaaggcuugacugg

SEQ ID NO: 759743 - RNA, 62 nt, Homo Sapiens
uauaccaaguucaaaacacuuucagauagaagucuuucuaugcaaagauuaaaguaugacuu

SEQ ID NO: 759744 - RNA, 62 nt, Homo Sapiens
gauuucuaaauauauaaaauaacaagaaccucucuuucuaggcuauuaauaagaaaccaaca

SEQ ID NO: 759745 - RNA, 62 nt, Homo Sapiens
cacuugucccauuucauucuaaaauaauugguucuuucuaaaauuucagguauaggaauuau

SEQ ID NO: 759746 - RNA, 62 nt, Homo Sapiens
cugccuaaacucuaggccauuguagcaaaauuucuuucuaacacugaacgagcauaaauaaa

SEQ ID NO: 759747 - RNA, 62 nt, Homo Sapiens
auugucuauuaaagcagaggcccguuaacaugucuuucuaaauuaguauugugugauuuucc

SEQ ID NO: 759748 - RNA, 62 nt, Homo Sapiens
ccuauuugauaguuugagucaacuguguguucucuuucuauuccuuuucuauuugcguucaa

SEQ ID NO: 759749 - RNA, 62 nt, Homo Sapiens
caaaggaugacuguaggccgugugcuggccuuucuuucuaagaagcugcuuugagcuccugg

SEQ ID NO: 759750 - RNA, 62 nt, Homo Sapiens
ugugaaauucguuuucuuuuucauggugccuuucuuucuaagaaaagauagaaagaaugggg

SEQ ID NO: 759751 - RNA, 62 nt, Homo Sapiens
aaaaggcuucaaggaauuuaucucaacauuauucuuucuauguccuaacuaaauuucucaac

SEQ ID NO: 759752 - RNA, 62 nt, Homo Sapiens
guuuuuguucuacauauuuuucaauaauuuauucuuucuaauguugaaauuauaucaggcuu

SEQ ID NO: 759753 - RNA, 62 nt, Homo Sapiens
ucucuuuauuuuucuuucuuucuuucccuuucucuuucuaucguuuguuuuuucucucucuu

SEQ ID NO: 759754 - RNA, 62 nt, Homo Sapiens
aucucuccccacccucugaguauuccuuuuguucuuucuagcacuugagauuuaaaaacugc

SEQ ID NO: 759755 - RNA, 62 nt, Homo Sapiens
uccacaggugcagcccucccgguagaggaaguucuuucuacuuccagcuucuugcuugggca

SEQ ID NO: 759756 - RNA, 62 nt, Homo Sapiens
ugugccacuaugggcacuagcuugaggcuggaucuuucuacucaaccauguccgccccagcu

SEQ ID NO: 759757 - RNA, 62 nt, Homo Sapiens
aauuuagaaaauguuaucuugaaugugaauauucuuucuaaacgugaaacccaugacaaaau

SEQ ID NO: 759758 - RNA, 62 nt, Homo Sapiens
aacugaacacaaaacucaggguuguaugagucucuuucuaugguccucuuauuaugcuuuua

SEQ ID NO: 759759 - RNA, 62 nt, Homo Sapiens
caccuuagaacuuuuugguuccagcauucagaucuuucuaguucauuagaacaaugaauuau

SEQ ID NO: 759760 - RNA, 62 nt, Homo Sapiens
caacucgggcuguuuguuuucuuauuugcacuucuuucuacaagugguuuaugaauuguuuc

SEQ ID NO: 759761 - RNA, 62 nt, Homo Sapiens
ccucuuuucauuuucucccacaggccucucuuucuuucuagguugcuggggagaaaugggua

SEQ ID NO: 759762 - RNA, 62 nt, Homo Sapiens
ucuugggaugcccugaguugcuucccauuuccucuuucuagccguccuuuucuagugugugc

SEQ ID NO: 759763 - RNA, 62 nt, Homo Sapiens
cuugcugguuucaagauuagauggccucauucucuuucuaaugggaaagucugagugaaagg

SEQ ID NO: 759764 - RNA, 62 nt, Homo Sapiens
aauguuugcuccugguuggaauaugcccuggcucuuucuaccauucuggguguaaagaguaa

SEQ ID NO: 759765 - RNA, 62 nt, Homo Sapiens
aagggguuauuggucaguggugcuuuuaugugucuuucuacagcauauuucuuugagcacug

SEQ ID NO: 759766 - RNA, 62 nt, Homo Sapiens
gaaaugucaauucaaucccaucugaguaugccucuuucuauuccucaauccauguagggaca

SEQ ID NO: 759767 - RNA, 64 nt, Homo Sapiens
aauugguccauggcuacacuccucuucuccuugggccaguuaauagauaaagaauaguuuucuu

SEQ ID NO: 759768 - RNA, 64 nt, Homo Sapiens
cacccacaggucccccuacuuaacucgugcaagagccaguuaccggaaugaccaagagacaagu

SEQ ID NO: 759769 - RNA, 64 nt, Homo Sapiens
aagaacaguaaacagugaugacaaaggaguaacugccaguuaggcauugugauuuguacuaucu

SEQ ID NO: 759770 - RNA, 64 nt, Homo Sapiens
ggaaaggaauggaaaaaagagcuggcauugggaggccaguuacuugcaugaaucuaccugaguu

SEQ ID NO: 759771 - RNA, 64 nt, Homo Sapiens
uugugguuuugaaguuuguacuuucucugugggugccaguuaaauauuggagagcaaggaaugu

SEQ ID NO: 759772 - RNA, 64 nt, Homo Sapiens
caagacccugucucagaaaaaaagaaaauucaaggccaguuaagacaaaaugcuaugacuuuga

SEQ ID NO: 759773 - RNA, 64 nt, Homo Sapiens
auuccuuagaaauuggaugaaaccaagguuagaugccaguuaaauuuugcuuacagcauauggu

SEQ ID NO: 759774 - RNA, 64 nt, Homo Sapiens
gagcauuagaagaggugguuuuauaggaagcacugccaguuaaaucucuauugcuuggugucau

SEQ ID NO: 759775 - RNA, 64 nt, Homo Sapiens
ggaaucaaacugccuggguuccagucccagcucugccaguuaugcccagcuguggggacuuggg

SEQ ID NO: 759776 - RNA, 64 nt, Homo Sapiens
caggaaugguaucaauuccccuguuucucuuguagccaguuacuagaauaaaaucaucuacuuu

SEQ ID NO: 759777 - RNA, 64 nt, Homo Sapiens
uagccuugguaucauuuucuagcaauaacugagagccaguuaauuuuaagaauuucacacauuu

SEQ ID NO: 759778 - RNA, 64 nt, Homo Sapiens
aggugggugcagcugaaaguaaacagaauggauugccaguuacauguaugccugcccaguuccc

SEQ ID NO: 759779 - RNA, 64 nt, Homo Sapiens
uggaucaucaaaaaaauaaaguaaaauagaaaacugagaaaacucaauccaugaccagggagaa

SEQ ID NO: 759780 - RNA, 64 nt, Homo Sapiens
uuaauugguaggguaagcagacacucugaaacaaugagaaaaauacuaaaaauugacuugaguu

SEQ ID NO: 759781 - RNA, 64 nt, Homo Sapiens
caguauaccuaugugugcagcaguaaaaaauuagugagaaaaagcaacuuuuugucacucuuag

SEQ ID NO: 759782 - RNA, 64 nt, Homo Sapiens
agaagcaguguaguucuaccucucauuuuacagaugagaaaaccgaagcccagaaaaacucuca

SEQ ID NO: 759783 - RNA, 64 nt, Homo Sapiens
uuuuuuuaaauaaauuauuuaugaaacagauuuaugagaaaaguugauguuauuauauaugcuu

SEQ ID NO: 759784 - RNA, 64 nt, Homo Sapiens
cuuuaguuccaauugacaguuuuagguggagaaaugagaaaaagguuauauuuguuuuccugua

SEQ ID NO: 759785 - RNA, 64 nt, Homo Sapiens
aggcaguguaacaaccuauagugccauugauccaugagaaaaagauuuucugguacuacuccaa

SEQ ID NO: 759786 - RNA, 64 nt, Homo Sapiens
aacuuuuaauuuuuauuuuggcaaaacugucaaaugagaaaaaugauuuuaaaaacuuuuuuuu

SEQ ID NO: 759787 - RNA, 64 nt, Homo Sapiens
cugagccaggaacuacaagcgggugccacuccccugagaaaagagaucugccaaguggauacug

SEQ ID NO: 759788 - RNA, 64 nt, Homo Sapiens
cauauucuccuaauacaacccauucugggaaaacugagaaaaccggggcauugaggagcuuccu

SEQ ID NO: 759789 - RNA, 64 nt, Homo Sapiens
gguuacuuuguuauucagcuggccugaaauaauuugagaaaaaauaaguuccguuauauacugu

SEQ ID NO: 759790 - RNA, 64 nt, Homo Sapiens
acagaguuuuagaaaugagauuaaguuuuagaaaugagaaaaauaggucaguuugauuggauac

SEQ ID NO: 759791 - RNA, 64 nt, Homo Sapiens
caugcacacacacaaaaaauaccuaaauuuuggaugagaaaaugauaaaauaugcuaaguucua

SEQ ID NO: 759792 - RNA, 64 nt, Homo Sapiens
uggugggaugguaauggggauuagagaacugacaugagaaaagaggagcuguuuugguauuaaa

SEQ ID NO: 759793 - RNA, 64 nt, Homo Sapiens
ccuucaauccuggccaaguuggaguagacugguaugagaaaacuaugauuaguucacauuuacu

SEQ ID NO: 759794 - RNA, 64 nt, Homo Sapiens
uacuuguacuucuaauaacauuuuucaugaaucaugagaaaauuuccacagauacuucccuuag

SEQ ID NO: 759795 - RNA, 64 nt, Homo Sapiens
auauuuauagagcaucaaucaauauaagcauuauugagaaaaaugugacccguaacacuguguu

SEQ ID NO: 759796 - RNA, 64 nt, Homo Sapiens
gaaauacgacagggugugguagaauucagcaauaugagaaaaccagccccuaaaaugauagcca

SEQ ID NO: 759797 - RNA, 64 nt, Homo Sapiens
gaacacucuuagaauucccauuuaauaaaccauaugagaaaacccucuauuacucuuacacuuu

SEQ ID NO: 759798 - RNA, 64 nt, Homo Sapiens
aauaugacuagaaaaauuaguguuauauugggugugagaaaagacugugucuugaaagaauuau

SEQ ID NO: 759799 - RNA, 64 nt, Homo Sapiens
aucaauccuaacuagaaauacuaaaaauggcuuuugagaaaaauacuuccucugcuuguauuuu

SEQ ID NO: 759800 - RNA, 64 nt, Homo Sapiens
aucacuguuaaagccauugacuccuuuaguacacugagaaaaaucuuauaguaaaacuagccuu

SEQ ID NO: 759801 - RNA, 64 nt, Homo Sapiens
acuguacagacuguuuacuaaggagcuaaaccacugagaaaacguuauuaaaauuguaauaccu

SEQ ID NO: 759802 - RNA, 64 nt, Homo Sapiens
auuuguguacaauauacccauugaauguauauccugagaaaaauuggggccaaagaagcaggaa

SEQ ID NO: 759803 - RNA, 64 nt, Homo Sapiens
agaggacugaaaaaacaaauagcugaugugcaguugagaaaacuauucauaaaaaaaaucaagu

SEQ ID NO: 759804 - RNA, 64 nt, Homo Sapiens
acauaauggauguggauguggaucccuaggggcaugagaaaagcuauacuugaccaagcaccau

SEQ ID NO: 759805 - RNA, 64 nt, Homo Sapiens
ucuggacuuaagaguuucugagguuuaguuauccugagaaaacaucuauauaggugauuuuacc

SEQ ID NO: 759806 - RNA, 64 nt, Homo Sapiens
aaaauagcaucuaguccaacauuauaguuagagcugagaaaaaagucuucuuauguugacuaaa

SEQ ID NO: 759807 - RNA, 64 nt, Homo Sapiens
auuacccaguaacauugaauugggaauuauaauuugagaaaaaugucacagguaaaaucagugu

SEQ ID NO: 759808 - RNA, 64 nt, Homo Sapiens
uuauuuuuacugaaagcaagagauugaaaaguuuugagaaaaugaguacaagcuauuaaaaauc

SEQ ID NO: 759809 - RNA, 64 nt, Homo Sapiens
cucacaccuuauugcacaggaaagcauuuauacuugagaaaaauuguauaaagaauauggaaaa

SEQ ID NO: 759810 - RNA, 64 nt, Homo Sapiens
uacauguucagacuaacauucuuuugcaguauagugagaaaaaaacauuuuaaaauuaauuauc

SEQ ID NO: 759811 - RNA, 64 nt, Homo Sapiens
uuaacauuuugcacagaauauaucaaauauauuuugagaaaaaaaguacggcaugaguucuguu

SEQ ID NO: 759812 - RNA, 64 nt, Homo Sapiens
cacaaaaaaucuuauuucagaauggaaauauuuuugagaaaaguagcugaguauacugguuuaa

SEQ ID NO: 759813 - RNA, 64 nt, Homo Sapiens
caggcaauacuauuuuaaagagauucucacugccugagaaaaccgaggaggagaaagaauccaa

SEQ ID NO: 759814 - RNA, 64 nt, Homo Sapiens
ucaccgcaucagcugguugcaagacaggagaugaugagaaaagcugggcgacagaucugaagug

SEQ ID NO: 759815 - RNA, 64 nt, Homo Sapiens
acucauuccuuagucaauaccagcauuuuuccagugagaaaacuaucuugacaggauaguggaa

SEQ ID NO: 759816 - RNA, 64 nt, Homo Sapiens
gggggacaaaacauaaagccaucaagcacgugcuugagaaaaaaauuauaauuuugaauaaaga

SEQ ID NO: 759817 - RNA, 64 nt, Homo Sapiens
uuguguaggacucuguaaucuuuugauuaguuucugagaaaacacaaugaagcacuucacuuuu

SEQ ID NO: 759818 - RNA, 64 nt, Homo Sapiens
auuuuaauuauaguuuuguuauaaauauaacuuaugagaaaaaaauuugauaggaauaauacug

SEQ ID NO: 759819 - RNA, 64 nt, Homo Sapiens
auaaaauaaauucccaauucaauaacaagauaauugagaaaaaacaaaauaauugagaaaaaua

SEQ ID NO: 759820 - RNA, 64 nt, Homo Sapiens
aaauaacaagauaauugagagagagcaaaauaauugagaaaaauggccaaacuugagccaaucu

SEQ ID NO: 759821 - RNA, 64 nt, Homo Sapiens
uguugauguugaugggagucuaugauugagcaaaugagaaaacaaaacuauuucagauguauua

SEQ ID NO: 759822 - RNA, 64 nt, Homo Sapiens
aagcuauucacauuguuaagugguuuccuccauuugagaaaauacuugauccacuaugccuuaa

SEQ ID NO: 759823 - RNA, 64 nt, Homo Sapiens
gaaauaaagcuacugggccugagucacuaugggaugagaaaauuaacaguuuuuauuaaaacau

SEQ ID NO: 759824 - RNA, 64 nt, Homo Sapiens
ccugacaguuuaauuuaaaaaaggaaaaccugucugagaaaauguucuucauuacugcauugaa

SEQ ID NO: 759825 - RNA, 64 nt, Homo Sapiens
uagauuuuugucuguacaaagacacagaacccuuugagaaaacuaauugcccccauguguaggg

SEQ ID NO: 759826 - RNA, 64 nt, Homo Sapiens
uuaauacaacagguguccagaauuuuuguuugaaugagaaaaguauuuuacugccuuuccuuuu

SEQ ID NO: 759827 - RNA, 64 nt, Homo Sapiens
cuucuuccuuugcuucaggccccagugaauggaaugagaaaagcaauacuccauccccuucccu

SEQ ID NO: 759828 - RNA, 64 nt, Homo Sapiens
aggcagagcauggaaaaggaaugccuucaauuucugagaaaaugaacaaaaaaauaauaaucaa

SEQ ID NO: 759829 - RNA, 64 nt, Homo Sapiens
uuuccaagugccuggccagaguuuucauuuuucaugagaaaagcggcagggcccaaggccccag

SEQ ID NO: 759830 - RNA, 64 nt, Homo Sapiens
guugguuucuaacagacuacuuccaaaaacaguuugagaaaaaaacugucugauuuuaagucuc

SEQ ID NO: 759831 - RNA, 64 nt, Homo Sapiens
guuuagaauuacaaaauaguuuuuaaauauugucugagaaaagccaaaguuaaugcaaccuagu

SEQ ID NO: 759832 - RNA, 64 nt, Homo Sapiens
uuguuuuucucccuaaucuaucagcugcacuacuugagaaaauuuaaaguguuucuaguuaaau

SEQ ID NO: 759833 - RNA, 64 nt, Homo Sapiens
uccaaaucuacuguacugucagcuucacuccaccugagaaaaaagaaaaaaaaauugauagcuc

SEQ ID NO: 759834 - RNA, 64 nt, Homo Sapiens
ucugcacagaaagucccaguacaacuuccauugcugagaaaauccucagaggacuuucccacuu

SEQ ID NO: 759835 - RNA, 64 nt, Homo Sapiens
gaaaaaaaucaguaccacauuuggacaguauaggugagaaaacauaauuauaaaaaugaugcca

SEQ ID NO: 759836 - RNA, 64 nt, Homo Sapiens
uucaaggaauaaagauuguugaaaauaagacuucugagaaaaagaaggaagaaaauguagauua

SEQ ID NO: 759837 - RNA, 64 nt, Homo Sapiens
uaucccuuuuacggauucagcaagguuuaggaggugagaaaaagugugaucacuaaaaugaggc

SEQ ID NO: 759838 - RNA, 64 nt, Homo Sapiens
uuucaaaccacacauuaguacuuauguugcacaaugagaaaagaaauuaguuucaaauuuaccu

SEQ ID NO: 759839 - RNA, 64 nt, Homo Sapiens
uuuuuucaacaaaauggucauccaaacucaaacuugagaaaauaucuugcuuucaaauuggcac

SEQ ID NO: 759840 - RNA, 64 nt, Homo Sapiens
uguuuugguaauuauuucauauauuguuguuuauugagaaaagguuguaggaugugucacaaga

SEQ ID NO: 759841 - RNA, 64 nt, Homo Sapiens
uaaccugcaucccauuuccagccucuuuucaagcugagaaaaaaaaaaaaaaacacguuugaua

SEQ ID NO: 759842 - RNA, 64 nt, Homo Sapiens
gagguuuauggucuguucuccuccauuuaacagaugagaaaauguguuaagccaggacuguuau

SEQ ID NO: 759843 - RNA, 64 nt, Homo Sapiens
cugccaaguaaaucagcaggagcuugcaguauagugagaaaagcaauuaucucugccuucaagg

SEQ ID NO: 759844 - RNA, 64 nt, Homo Sapiens
aaaaaaaccugccgauuaacgaaaacagaacaaaugagaaaagauuaaucauaacuaaaacauu

SEQ ID NO: 759845 - RNA, 64 nt, Homo Sapiens
accuaaaucccagaaaagagguaggacuuggcugugagaaaaucaguuccugcuuucuuuugcg

SEQ ID NO: 759846 - RNA, 64 nt, Homo Sapiens
uuccugaaaguagaacugaauuggaagauguaggugagaaaauauucaaaaguaauuaauagug

SEQ ID NO: 759847 - RNA, 64 nt, Homo Sapiens
auguuucguaaauauuugcagcaucuauguaaagugagaaaaauuuuuacaaaugaaaugauag

SEQ ID NO: 759848 - RNA, 64 nt, Homo Sapiens
gaaauguaaaggauuuuugaggaagauauuacuuugagaaaacagaaauguccaagggguuggg

SEQ ID NO: 759849 - RNA, 64 nt, Homo Sapiens
gaaucccugacagcugugucaaugcaaaccuaaaugagaaaaugucacagacuugagagcaaua

SEQ ID NO: 759850 - RNA, 64 nt, Homo Sapiens
cuggaagaaggggguaaaaguuugcuuuggugagugagaaaaggcuggggcgugugauccaucc

SEQ ID NO: 759851 - RNA, 64 nt, Homo Sapiens
gcugaaugacauucaagcugauuuucuagaccacugagaaaaucuuuauuuacaauaaauuuca

SEQ ID NO: 759852 - RNA, 64 nt, Homo Sapiens
ccuaugaauguggcagacuauaaaaauuguauacugagaaaaauauauuuuaggacauuauguc

SEQ ID NO: 759853 - RNA, 64 nt, Homo Sapiens
uuuuaggacauuaugucuaaauguacaaaacauuugagaaaauauguuuugugucagagaaaac

SEQ ID NO: 759854 - RNA, 64 nt, Homo Sapiens
gugauuacaugguccuucaaacucccaaccaaagugagaaaagcggcaugcagugaaaugagca

SEQ ID NO: 759855 - RNA, 64 nt, Homo Sapiens
gagagagauaaccugucugucauaacuuaaaggaugagaaaaugugguguagcuauuaaagauu

SEQ ID NO: 759856 - RNA, 64 nt, Homo Sapiens
gagaggugaggugacuugccgcccacuucauagaugagaaaacuaugaagagaaggaggguugu

SEQ ID NO: 759857 - RNA, 64 nt, Homo Sapiens
caggagagcuucccccaagguugcucacacuacuugagaaaaugccauuugccagauugcccca

SEQ ID NO: 759858 - RNA, 64 nt, Homo Sapiens
gagcauugugggaaaaacuguugucaaaacuaggugagaaaauaugggaagagaaggaauaaau

SEQ ID NO: 759859 - RNA, 64 nt, Homo Sapiens
auaaaggguuauaauuugaaguuuguaguauucuugagaaaaaguacuuuaauguuuaggguca

SEQ ID NO: 759860 - RNA, 64 nt, Homo Sapiens
acaucaccaacuuaauuuucuuccauagcaaaacugagaaaauaccuuguuucaguauaacacu

SEQ ID NO: 759861 - RNA, 64 nt, Homo Sapiens
uuaugucacacacacaaaaaauccuuuucaauccugagaaaauuaaaggcguuuuacucacaug

SEQ ID NO: 759862 - RNA, 64 nt, Homo Sapiens
uuaauuucaaauagaauauggacuuaaauguuaaugagaaaauggcuuuaaucaauucuagcau

SEQ ID NO: 759863 - RNA, 64 nt, Homo Sapiens
uauuggaagauaaacuugucaaacuugucaagaaugagaaaagccaaauuagaaaauccuaugu

SEQ ID NO: 759864 - RNA, 64 nt, Homo Sapiens
guaagaaaaaaaaaaauccuaaaaagaaaaaaaaugagaaaaaaugcuaucuauaaaaaagaga

SEQ ID NO: 759865 - RNA, 64 nt, Homo Sapiens
uauacuugcuaucuauaaaauucauagaguucuaugagaaaaaauggaaagaaguuauagaauc

SEQ ID NO: 759866 - RNA, 64 nt, Homo Sapiens
auauccaguaauaguauugaucauuucucuaaugugagaaaaauauguuuuauugaaauuagau

SEQ ID NO: 759867 - RNA, 64 nt, Homo Sapiens
gcaauuuaucaaaauuaaacaucaaugcugauucugagaaaagaaaggauaauauauuuucccc

SEQ ID NO: 759868 - RNA, 64 nt, Homo Sapiens
acaucaccaacuugauuuucuuccauagcaaaacugagaaaauaccuuguuucaguauaacacu

SEQ ID NO: 759869 - RNA, 64 nt, Homo Sapiens
uaugucacacacacaaaaaaauccuuuucaauccugagaaaauuaaagguguuuuacucacaug

SEQ ID NO: 759870 - RNA, 64 nt, Homo Sapiens
uucuggaucucuuaguagggggaaaguagaaaaucgaguagaauuuggccucaggucaauaaau

SEQ ID NO: 759871 - RNA, 64 nt, Homo Sapiens
acuucccgucucagaaucuaaacguggucaccuucgaguagagaggcccgcccgcccaccgugg

SEQ ID NO: 759872 - RNA, 64 nt, Homo Sapiens
gccuggcucagcccacaggcgcugccuaucugggcgaguagacccagaacguggcugcccaggg

SEQ ID NO: 759873 - RNA, 64 nt, Homo Sapiens
ccugggcucaagccaucccccaaccuuggccucucgaguagaugggauuauaggcaugugccac

SEQ ID NO: 759874 - RNA, 64 nt, Homo Sapiens
gaaauguaucuuagcaucugagagauguuaaugucgaguagaaacuucaccuuugcuucuacau

SEQ ID NO: 759875 - RNA, 64 nt, Homo Sapiens
ucaguggugaugccucuugcagaucuugucagagcgaguagaggccuacaugggcuuugugccc

SEQ ID NO: 759876 - RNA, 64 nt, Homo Sapiens
uucgggcccgcggugcucggggccugguguggggcgaguagagacuuccccagccuggacgggc

SEQ ID NO: 759877 - RNA, 64 nt, Homo Sapiens
aggguuuuuuuuuuuugacaaauucaacauucaacgaguagacaaaaugcuaauuauuucccug

SEQ ID NO: 759878 - RNA, 64 nt, Homo Sapiens
aauuguuagaaagcaucaggaugaccaguuaucucgaguagauuuucuuggauuucagaacauc

SEQ ID NO: 759879 - RNA, 64 nt, Homo Sapiens
acuguauuuguuaauuucuugcaauuugaagguacgaguagagguuuaaagaaaaaucaguuuu

SEQ ID NO: 759880 - RNA, 64 nt, Homo Sapiens
uauuuuuaaacacuuuuuuucauaauacauauuccgaguagauauuuauaaaauauauguuucu

SEQ ID NO: 759881 - RNA, 64 nt, Homo Sapiens
ugggaaagagcccauuggagcccacgauuccuuucgaguagaugaagaaaagcccaaagggaaa

SEQ ID NO: 759882 - RNA, 64 nt, Homo Sapiens
gccaugccagcuggccuuuguaagugcaggaaaccgaguagaaaaugugacccuccaaauggag

SEQ ID NO: 759883 - RNA, 64 nt, Homo Sapiens
ccacagucauugaaaagacagaaaggaucuuguucgaguagaaggucacagugcaauuaggcca

SEQ ID NO: 759884 - RNA, 64 nt, Homo Sapiens
ucaucuuuauauuaaacuucuaaacucuaugcuccgaguagaguguguuguguagaacucuuuu

SEQ ID NO: 759885 - RNA, 64 nt, Homo Sapiens
gaucaucucugcagguuuccuaggucugaaucugcgaguagaugaaccugcagcaagcagcguu

SEQ ID NO: 759886 - RNA, 64 nt, Homo Sapiens
acacaucaauuaaaggagacaaaaagaggcagagcgaguagagagcagcccucauucaccaccu

SEQ ID NO: 759887 - RNA, 64 nt, Homo Sapiens
gcuauuuuguaaaccgcugagguauggauaggaacgaguagaucagaccucuugaaaaugcuua

SEQ ID NO: 759888 - RNA, 64 nt, Homo Sapiens
aaggcuaucccagaaauauuucaaccagcagcuucgaguagagagggcaaagucuacuggcgcc

SEQ ID NO: 759889 - RNA, 64 nt, Homo Sapiens
cauuuaggaacuugggggcugaagauacuuggaccgaguagaggcuaacaguucacuugcagug

SEQ ID NO: 759890 - RNA, 64 nt, Homo Sapiens
guaaaaagaaggaaaaggaguuaauggggagggacgaguagaugugcaacuuacuaauacuuua

SEQ ID NO: 759891 - RNA, 64 nt, Homo Sapiens
ccugaucgcaguaaagugguccuugguaacugcucgaguagaacaugucugcauccgccaauag

SEQ ID NO: 759892 - RNA, 64 nt, Homo Sapiens
guagagacagaucuguuuuaagcaguuggggguucgaguagaucucauggguacaggaggccag

SEQ ID NO: 759893 - RNA, 64 nt, Homo Sapiens
cacaauuccagaaugguaaguccggcaguaccugcgaguagagaggcuguggugauggaucugc

SEQ ID NO: 759894 - RNA, 64 nt, Homo Sapiens
guaaacauuuaaaggggaaaggaaggauucagcacgaguagaugaacgcuggagcaaucuccuu

SEQ ID NO: 759895 - RNA, 64 nt, Homo Sapiens
aauauauacccagaguaugugagaugucuauugccgaguagaguggcaggaauucuauuuucgg

SEQ ID NO: 759896 - RNA, 64 nt, Homo Sapiens
uaguaccuugccacucuacccccaacacgucacccgaguagaagcugggcaaggcccuaccauc

SEQ ID NO: 759897 - RNA, 64 nt, Homo Sapiens
ugguugcuaagaccugaaucccauauugagaucucgaguagaauccuuggugugguuucuggug

SEQ ID NO: 759898 - RNA, 64 nt, Homo Sapiens
ucugccuagugagugagcaggucagaucacuucucgaguagaggcgagcaucagcuacugcggu

SEQ ID NO: 759899 - RNA, 64 nt, Homo Sapiens
cccuagggcuuguuggaggagagcaagcuggauccgaguagauugggcaccacaguguuuccaa

SEQ ID NO: 759900 - RNA, 62 nt, Homo Sapiens
aggaggccacaucacuagcaguagggagaacaagaugucauuuguguucaguguaagcugag

SEQ ID NO: 759901 - RNA, 62 nt, Homo Sapiens
ucuagcccucacaguaacagagcuaagaauucagaugucaggaagucugugaaucuugaugg

SEQ ID NO: 759902 - RNA, 62 nt, Homo Sapiens
cuggccguggagucgagcuggugcagggaccaagaugucaagucccagacagcagugugagg

SEQ ID NO: 759903 - RNA, 62 nt, Homo Sapiens
caaauucauucccuucucucuaaauggcagugagaugucagagugggcccuggcucugucac

SEQ ID NO: 759904 - RNA, 62 nt, Homo Sapiens
gcauugccucagcaccccagugcucuugaagaagaugucauguuccauaauaaacuguuagg

SEQ ID NO: 759905 - RNA, 62 nt, Homo Sapiens
uguuuaguuuuuauauguguugaacguguuucagaugucaugagaaggcaaggaccaauguu

SEQ ID NO: 759906 - RNA, 62 nt, Homo Sapiens
uagguauaaaaggugacucagaguagagaguaagaugucagcaaauagacaauaagauguca

SEQ ID NO: 759907 - RNA, 62 nt, Homo Sapiens
guagagaguaagaugucagcaaauagacaauaagaugucagcaaaagugccucaaauuuuaa

SEQ ID NO: 759908 - RNA, 62 nt, Homo Sapiens
uccccucucuuauuuuaaguaccuagaucuccagaugucauuucaauugcaaugggccacau

SEQ ID NO: 759909 - RNA, 62 nt, Homo Sapiens
ggugugaugaagggagaguaauauaaauugcaagaugucacauuagauaaugacacaaucaa

SEQ ID NO: 759910 - RNA, 62 nt, Homo Sapiens
uuauugaggagucucagagcaaggugcguucuagaugucauccuaaaaaacacuucauauau

SEQ ID NO: 759911 - RNA, 62 nt, Homo Sapiens
uagaaugcuuaaaugugcuguaaaacuauuguagaugucacuggauuuuaccaaguaauauc

SEQ ID NO: 759912 - RNA, 62 nt, Homo Sapiens
cugccaaauaaaaauauuucuaaauuauccagagaugucaaaaacuccaucuuagugaauuu

SEQ ID NO: 759913 - RNA, 62 nt, Homo Sapiens
cuugaccucacuuagcagggacagaacaucuuagaugucagcgaugggggccagguuccgcc

SEQ ID NO: 759914 - RNA, 62 nt, Homo Sapiens
cuaauccacuucccuaagaccucugggccuucagaugucaccccucucuauuaauauuaaaa

SEQ ID NO: 759915 - RNA, 62 nt, Homo Sapiens
cccaccagcaucaccaaaguguucugauugcuagaugucacauccugugagucauuggcugg

SEQ ID NO: 759916 - RNA, 62 nt, Homo Sapiens
uguagaggagagagagcgagaggccaucucuaagaugucagaucguccucccuuucucuaag

SEQ ID NO: 759917 - RNA, 62 nt, Homo Sapiens
aacauuccacaucguccucccaguuuuuguaaagaugucaguuguguugaguggaaaaaaau

SEQ ID NO: 759918 - RNA, 64 nt, Homo Sapiens; identical to SEQ ID NO: 195961

SEQ ID NO: 759919 - RNA, 64 nt, Homo Sapiens; identical to SEQ ID NO: 195962

SEQ ID NO: 759920 - RNA, 64 nt, Homo Sapiens; identical to SEQ ID NO: 195963

SEQ ID NO: 759921 - RNA, 64 nt, Homo Sapiens; identical to SEQ ID NO: 195964

SEQ ID NO: 759922 - RNA, 64 nt, Homo Sapiens; identical to SEQ ID NO: 195965

SEQ ID NO: 759923 - RNA, 64 nt, Homo Sapiens; identical to SEQ ID NO: 195966

SEQ ID NO: 759924 - RNA, 64 nt, Homo Sapiens; identical to SEQ ID NO: 195967

SEQ ID NO: 759925 - RNA, 64 nt, Homo Sapiens; identical to SEQ ID NO: 195968

SEQ ID NO: 759926 - RNA, 64 nt, Homo Sapiens; identical to SEQ ID NO: 195969

SEQ ID NO: 759927 - RNA, 64 nt, Homo Sapiens; identical to SEQ ID NO: 195970

SEQ ID NO: 759928 - RNA, 64 nt, Homo Sapiens; identical to SEQ ID NO: 195971

SEQ ID NO: 759929 - RNA, 64 nt, Homo Sapiens; identical to SEQ ID NO: 195972

SEQ ID NO: 759930 - RNA, 64 nt, Homo Sapiens; identical to SEQ ID NO: 195973

SEQ ID NO: 759931 - RNA, 64 nt, Homo Sapiens; identical to SEQ ID NO: 195974

SEQ ID NO: 759932 - RNA, 64 nt, Homo Sapiens; identical to SEQ ID NO: 195975

SEQ ID NO: 759933 - RNA, 64 nt, Homo Sapiens; identical to SEQ ID NO: 195976

SEQ ID NO: 759934 - RNA, 64 nt, Homo Sapiens; identical to SEQ ID NO: 195977

SEQ ID NO: 759935 - RNA, 64 nt, Homo Sapiens; identical to SEQ ID NO: 195978

SEQ ID NO: 759936 - RNA, 64 nt, Homo Sapiens; identical to SEQ ID NO: 195979

SEQ ID NO: 759937 - RNA, 64 nt, Homo Sapiens; identical to SEQ ID NO: 195980

SEQ ID NO: 759938 - RNA, 64 nt, Homo Sapiens; identical to SEQ ID NO: 195981

SEQ ID NO: 759939 - RNA, 64 nt, Homo Sapiens; identical to SEQ ID NO: 195982

SEQ ID NO: 759940 - RNA, 64 nt, Homo Sapiens; identical to SEQ ID NO: 195983

SEQ ID NO: 759941 - RNA, 64 nt, Homo Sapiens; identical to SEQ ID NO: 195984

SEQ ID NO: 759942 - RNA, 64 nt, Homo Sapiens; identical to SEQ ID NO: 195985

SEQ ID NO: 759943 - RNA, 64 nt, Homo Sapiens; identical to SEQ ID NO: 195986

SEQ ID NO: 759944 - RNA, 64 nt, Homo Sapiens; identical to SEQ ID NO: 195987

SEQ ID NO: 759945 - RNA, 64 nt, Homo Sapiens
gucaaaaggcaggugcuagacagucuagaccaggguuucucaaacucguacuugacauuugggg

SEQ ID NO: 759946 - RNA, 64 nt, Homo Sapiens
acuuaaauuuaaguuaauuaagauuaaaagcucaguuucucagucacauuagucauucaagugu

SEQ ID NO: 759947 - RNA, 64 nt, Homo Sapiens
uagaauauuucuaguugagcuuuuguacuuuaagguuucucaauuacaacuuuccacaacuugu

SEQ ID NO: 759948 - RNA, 64 nt, Homo Sapiens
uguuuuugcuuuuaacuuugaaaaaugaaaaguuguuucucaguaggacuuuguaagucagcau

SEQ ID NO: 759949 - RNA, 64 nt, Homo Sapiens
gccagugaggccccaccacaucggugugaguuagguuucucaucuggagcuguuucucaggcau

SEQ ID NO: 759950 - RNA, 64 nt, Homo Sapiens
acaucggugugaguuagguuucucaucuggagcuguuucucaggcauucuucccaacccucuuc

SEQ ID NO: 759951 - RNA, 64 nt, Homo Sapiens
aguccuuuuagaggcuugcugaguuucugauucuguuucucagugggcccuaacuagaguucua

SEQ ID NO: 759952 - RNA, 64 nt, Homo Sapiens
gggugaaacaugucuuuagucaggggauccuucuguuucucacguugucaaaucaguuacuguu

SEQ ID NO: 759953 - RNA, 64 nt, Homo Sapiens
auuuuuuccgaggaugaacaggggacaucuuuagguuucucaacucuugcuuugguguuugccg

SEQ ID NO: 759954 - RNA, 64 nt, Homo Sapiens
ccgggcgaccugggacucagcaccaacggcugaaguuucucagcugggcucugaccuggggucu

SEQ ID NO: 759955 - RNA, 64 nt, Homo Sapiens
ugaagaguuugcucuuguaucccuauaguccaagguuucucaaucugcacaauugacauuuuug

SEQ ID NO: 759956 - RNA, 64 nt, Homo Sapiens
ccuucgcugacuucaccauuccucaaaccuguaaguuucucacuucuuccaaauuggcuuuggc

SEQ ID NO: 759957 - RNA, 64 nt, Homo Sapiens
uuauuuuccuugacccauuuuacauccuuuguuuguuucucauucuuuaaccucuaguuuucca

SEQ ID NO: 759958 - RNA, 64 nt, Homo Sapiens
aucuccauagaucgccugcaauaugcuaggcaguguuucucaaaucauuaaauaugaaauggau

SEQ ID NO: 759959 - RNA, 64 nt, Homo Sapiens
ccgucacacacgccccuuuuguguuuugguucaaguuucucagagccccucagagcuucuacau

SEQ ID NO: 759960 - RNA, 64 nt, Homo Sapiens
cccuugauauuuuaagcauuuucccaugucaugaguuucucagaaacauguuuuuaacaauugu

SEQ ID NO: 759961 - RNA, 64 nt, Homo Sapiens
ccacaggaagggaaguagacauuguaugcuuaugguuucucauuaugaaggugcagcuuguagg

SEQ ID NO: 759962 - RNA, 64 nt, Homo Sapiens
cugucuucaaccuacuuuuccuuuucucuuuuuuguuucucauccucucugugccaccucucca

SEQ ID NO: 759963 - RNA, 64 nt, Homo Sapiens
aagugagcaugcacggaccucuucccccuguccuguuucucacccagcaccuggggagaucggu

SEQ ID NO: 759964 - RNA, 64 nt, Homo Sapiens
ucccuguuuguagcaagacucugaugauaauucuguuucucaucugcccauucaguauuuuguu

SEQ ID NO: 759965 - RNA, 64 nt, Homo Sapiens
cuuaucacugcauugugaagaggaggaaaagugaaucacggagagagaaaggaaaggauagaau

SEQ ID NO: 759966 - RNA, 64 nt, Homo Sapiens
auccugcaguguuuaaggaacucuuuuuuuguaaaucacggacaccucaauuagcaagaacuga

SEQ ID NO: 759967 - RNA, 64 nt, Homo Sapiens
guccaaguaagcagucuggcuggaauaaggcagcaucacggaaauucuguaaggacugacacag

SEQ ID NO: 759968 - RNA, 64 nt, Homo Sapiens
uccacccggacacguggaacggcugugucuuucuaucacggauugagguuuaagugcaacacca

SEQ ID NO: 759969 - RNA, 64 nt, Homo Sapiens
gucuugucaaaagagugcugaaggaaggaucagcaucacggaagggccauugguucucaaacuu

SEQ ID NO: 759970 - RNA, 64 nt, Homo Sapiens
caauuuauguugugugccagggaaggugcauauuaucacggauguacucaagcaauaguugaag

SEQ ID NO: 759971 - RNA, 64 nt, Homo Sapiens
guauauuaaagcaccaaauucauguacagcaugcaucacggaucaauagacuguacuuauuuuc

SEQ ID NO: 759972 - RNA, 64 nt, Homo Sapiens
aggacuuggcaacaugauguuugacuguaaucucaucacggauauguaugaauuuuuacagguu

SEQ ID NO: 759973 - RNA, 64 nt, Homo Sapiens
augacucugagaaguugaauugcuugaagaguucaucacggaaauucaagaaacuuuacuucaa

SEQ ID NO: 759974 - RNA, 64 nt, Homo Sapiens
gguguagauaaucuagaggcuucuccaucugagaaucacggagacugccacugcccaccgccuc

SEQ ID NO: 759975 - RNA, 64 nt, Homo Sapiens
uuauguauaguuucucuaauuauucacucacauuaucacggaauuugagguacugcuauauaaa

SEQ ID NO: 759976 - RNA, 64 nt, Homo Sapiens
uacgacuuuggguacugcggcuacaucauagcucaucacggagccgucacugaguguggcuggg

SEQ ID NO: 759977 - RNA, 64 nt, Homo Sapiens
aucugggaagaguggagaaauuugccacuugacgaucacggauuagcuagcaccuuuaagcccu

SEQ ID NO: 759978 - RNA, 64 nt, Homo Sapiens
acagggagcagagacugcuuuaaucccugcugacaucacggaaaagcaacagagccuuuucaac

SEQ ID NO: 759979 - RNA, 64 nt, Homo Sapiens
cuaucuauugccuuuguaaaaaacagagaaaacgaucacggacagguaugcacugguaacaugc

SEQ ID NO: 759980 - RNA, 64 nt, Homo Sapiens
ucucgaggccacacucgcucggcaggauuaugcgaucacggaucagucagagcagggucaggag

SEQ ID NO: 759981 - RNA, 64 nt, Homo Sapiens
ucuagucaaccuacagcuuaaacaggauuggugaaucacggacuguuuuauacuacuuccauaa

SEQ ID NO: 759982 - RNA, 64 nt, Homo Sapiens
agauuagaaaucgcgacacauuuguagucauuguaucacggauuacaaugaacgcagugcagag

SEQ ID NO: 759983 - RNA, 64 nt, Homo Sapiens
accacccgagccugggagccagcgucccagccuaaucacggaucugcugccucccagcugucuu

SEQ ID NO: 759984 - RNA, 64 nt, Homo Sapiens
auguguuuuagauugauuucccuguuucagggaaaucacggacaguaguuucaguucugauggu

SEQ ID NO: 759985 - RNA, 64 nt, Homo Sapiens
guguugaaccugggacccugcugaguacucugacaucacggaaaccuguccccaucaucccuga

SEQ ID NO: 759986 - RNA, 64 nt, Homo Sapiens
uaggcucucaacaugacuauagagaccccgugucaucacggagaccuuuguuccugugggaaaa

SEQ ID NO: 759987 - RNA, 64 nt, Homo Sapiens
guauuucuucaugcuuuccagaguuagagccuugaucacggaacaucauugugugcagaagaau

SEQ ID NO: 759988 - RNA, 64 nt, Homo Sapiens
gaaaugccaaaccgaaggauuucugaggaccuaaaucacggagcaucaaucuuacaaaguguug

SEQ ID NO: 759989 - RNA, 64 nt, Homo Sapiens
acaucuccuacggccugcccuguucgcccgcuccaucacggauaggugagccaggagcccgugc

SEQ ID NO: 759990 - RNA, 64 nt, Homo Sapiens
ccuaauccugagucgucacccuuggauuuuauggaucacggagcugaccaucuuuaccuggucc

SEQ ID NO: 759991 - RNA, 64 nt, Homo Sapiens
ccuuaacagcaggaaacagaugccacagagaggcaucacggaagaaaaaaauggaggugguaga

SEQ ID NO: 759992 - RNA, 64 nt, Homo Sapiens
guguaaguauauguagguuuucaaguaucgcgccaucacggaagcaagcaaucgugauuguagg

SEQ ID NO: 759993 - RNA, 64 nt, Homo Sapiens
caggucaucuuguagaacuccagcuuuguugaaaaucacggaccucagcuacaucauacacuga

SEQ ID NO: 759994 - RNA, 64 nt, Homo Sapiens
gggugccaguccaucucaagugccauauucugugaucacggauguuggcucccccucgcccuau

SEQ ID NO: 759995 - RNA, 64 nt, Homo Sapiens
agacccuucacaagcaaaaucagccagcacuuugaucacggacuucccagccucuaggacugug

SEQ ID NO: 759996 - RNA, 64 nt, Homo Sapiens
gaaguggcugcccccuuaaccgcugggggcuguaaucacggagggacccacacagguccaccca

SEQ ID NO: 759997 - RNA, 64 nt, Homo Sapiens
guucucaagaguugauuguaagccauuguccacaaucacggaugagaaguuguuuggaccuuag

SEQ ID NO: 759998 - RNA, 64 nt, Homo Sapiens
ugacaugccauccauucugccgucguggaauuaaaucacggauggcagauuggagggucgccug

SEQ ID NO: 759999 - RNA, 64 nt, Homo Sapiens
cguggggcccacugcucguggacugugcuggugcaucacggauggugcaugggcucgccguguc

SEQ ID NO: 760000 - RNA, 64 nt, Homo Sapiens
accuggcccucccagccgucucaggcacuucugcaucacggaagagggcauuucaugaaccauc

SEQ ID NO: 760001 - RNA, 64 nt, Homo Sapiens
agccggaguggcggggcacgcugccgccuuccccaucacggaggguccagacuguccacucggg

SEQ ID NO: 760002 - RNA, 64 nt, Homo Sapiens
uuuccggugaauacgggauugcacuuacucuuucaucacggaaacagaccccccgagagaagcc

SEQ ID NO: 760003 - RNA, 64 nt, Homo Sapiens
cuaaacauuuuauagaaaauauuucuaaaauuuuaucacggaugaauggauggacuugcucucu

SEQ ID NO: 760004 - RNA, 64 nt, Homo Sapiens
gucauuccuucuccuuuccaaugugacuucgcucaucacggacagugacuauggagccaauggg

SEQ ID NO: 760005 - RNA, 64 nt, Homo Sapiens
uucacugaugacagguaacggcagacacucugacaucacggagcguguugccagacuuaaccca

SEQ ID NO: 760006 - RNA, 64 nt, Homo Sapiens
cacuguggucacagacuggaccaguguaccugucaucacggacgcacauccuaggagggaaagu

SEQ ID NO: 760007 - RNA, 64 nt, Homo Sapiens
gcuucauaucagacacgucaacgccaaguucaccaucacggagugauggaagagcaacugaggc

SEQ ID NO: 760008 - RNA, 64 nt, Homo Sapiens
uaaaguugaggccguggacggaucccccucuuccaucacggaggcggcccaccugggagccuca

SEQ ID NO: 760009 - RNA, 64 nt, Homo Sapiens
cuuuuuuccccuccaccgaauucggcuuuuggcaaucacggacauguguaauaauaaagaaaga

SEQ ID NO: 760010 - RNA, 64 nt, Homo Sapiens
aggcagucaaggaggaaggaagcuuauucuaucaaucacggaagaugucuguauguccgugcuu

SEQ ID NO: 760011 - RNA, 64 nt, Homo Sapiens
cuaccgaugugugaugucucgcggcuugugaggcaucacggaacaauaaaaacuugcugguuuu

SEQ ID NO: 760012 - RNA, 64 nt, Homo Sapiens
uucuucaucuugagucaucauguggauuuggaacaucacggacguuuucggaagcagcauucac

SEQ ID NO: 760013 - RNA, 64 nt, Homo Sapiens; identical to SEQ ID NO: 656770

SEQ ID NO: 760014 - RNA, 64 nt, Homo Sapiens; identical to SEQ ID NO: 656771

SEQ ID NO: 760015 - RNA, 64 nt, Homo Sapiens; identical to SEQ ID NO: 656772

SEQ ID NO: 760016 - RNA, 64 nt, Homo Sapiens; identical to SEQ ID NO: 656773

SEQ ID NO: 760017 - RNA, 64 nt, Homo Sapiens; identical to SEQ ID NO: 656774

SEQ ID NO: 760018 - RNA, 64 nt, Homo Sapiens; identical to SEQ ID NO: 656775

SEQ ID NO: 760019 - RNA, 64 nt, Homo Sapiens; identical to SEQ ID NO: 264152

SEQ ID NO: 760020 - RNA, 64 nt, Homo Sapiens; identical to SEQ ID NO: 264153

SEQ ID NO: 760021 - RNA, 64 nt, Homo Sapiens; identical to SEQ ID NO: 264154

SEQ ID NO: 760022 - RNA, 64 nt, Homo Sapiens; identical to SEQ ID NO: 264155

SEQ ID NO: 760023 - RNA, 64 nt, Homo Sapiens; identical to SEQ ID NO: 264156

SEQ ID NO: 760024 - RNA, 64 nt, Homo Sapiens; identical to SEQ ID NO: 264157

SEQ ID NO: 760025 - RNA, 64 nt, Homo Sapiens; identical to SEQ ID NO: 264158

SEQ ID NO: 760026 - RNA, 64 nt, Homo Sapiens; identical to SEQ ID NO: 264159

SEQ ID NO: 760027 - RNA, 64 nt, Homo Sapiens; identical to SEQ ID NO: 264160

SEQ ID NO: 760028 - RNA, 64 nt, Homo Sapiens; identical to SEQ ID NO: 264161

SEQ ID NO: 760029 - RNA, 64 nt, Homo Sapiens; identical to SEQ ID NO: 264162

SEQ ID NO: 760030 - RNA, 64 nt, Homo Sapiens; identical to SEQ ID NO: 264163

SEQ ID NO: 760031 - RNA, 64 nt, Homo Sapiens; identical to SEQ ID NO: 264164

SEQ ID NO: 760032 - RNA, 64 nt, Homo Sapiens; identical to SEQ ID NO: 264165

SEQ ID NO: 760033 - RNA, 64 nt, Homo Sapiens; identical to SEQ ID NO: 264166

SEQ ID NO: 760034 - RNA, 64 nt, Homo Sapiens; identical to SEQ ID NO: 264167

SEQ ID NO: 760035 - RNA, 64 nt, Homo Sapiens; identical to SEQ ID NO: 264168

SEQ ID NO: 760036 - RNA, 64 nt, Homo Sapiens; identical to SEQ ID NO: 264169

SEQ ID NO: 760037 - RNA, 64 nt, Homo Sapiens; identical to SEQ ID NO: 264170

SEQ ID NO: 760038 - RNA, 64 nt, Homo Sapiens; identical to SEQ ID NO: 264171

SEQ ID NO: 760039 - RNA, 64 nt, Homo Sapiens
ugagcagcucccaagaaucacagagcugggacaggcagcuaaaaauuaccucagcgggagggag

SEQ ID NO: 760040 - RNA, 64 nt, Homo Sapiens
agaagucccugacggucacucugacuuuggagaggcagcuaagccacgguucuguugacggaug

SEQ ID NO: 760041 - RNA, 64 nt, Homo Sapiens; identical to SEQ ID NO: 86383

SEQ ID NO: 760042 - RNA, 64 nt, Homo Sapiens; identical to SEQ ID NO: 86384

SEQ ID NO: 760043 - RNA, 64 nt, Homo Sapiens; identical to SEQ ID NO: 86385

SEQ ID NO: 760044 - RNA, 64 nt, Homo Sapiens; identical to SEQ ID NO: 86386

SEQ ID NO: 760045 - RNA, 64 nt, Homo Sapiens; identical to SEQ ID NO: 86387

SEQ ID NO: 760046 - RNA, 64 nt, Homo Sapiens; identical to SEQ ID NO: 86388

SEQ ID NO: 760047 - RNA, 64 nt, Homo Sapiens; identical to SEQ ID NO: 86389

SEQ ID NO: 760048 - RNA, 64 nt, Homo Sapiens; identical to SEQ ID NO: 86390

SEQ ID NO: 760049 - RNA, 64 nt, Homo Sapiens; identical to SEQ ID NO: 86391

SEQ ID NO: 760050 - RNA, 64 nt, Homo Sapiens; identical to SEQ ID NO: 86392

SEQ ID NO: 760051 - RNA, 64 nt, Homo Sapiens; identical to SEQ ID NO: 86393

SEQ ID NO: 760052 - RNA, 64 nt, Homo Sapiens; identical to SEQ ID NO: 86394

SEQ ID NO: 760053 - RNA, 61 nt, Homo Sapiens; identical to SEQ ID NO: 86395

SEQ ID NO: 760054 - RNA, 64 nt, Homo Sapiens; identical to SEQ ID NO: 86396

SEQ ID NO: 760055 - RNA, 64 nt, Homo Sapiens; identical to SEQ ID NO: 86397

SEQ ID NO: 760056 - RNA, 64 nt, Homo Sapiens; identical to SEQ ID NO: 86398

SEQ ID NO: 760057 - RNA, 64 nt, Homo Sapiens; identical to SEQ ID NO: 86399

SEQ ID NO: 760058 - RNA, 64 nt, Homo Sapiens; identical to SEQ ID NO: 86400

SEQ ID NO: 760059 - RNA, 64 nt, Homo Sapiens; identical to SEQ ID NO: 86401

SEQ ID NO: 760060 - RNA, 64 nt, Homo Sapiens; identical to SEQ ID NO: 86402

SEQ ID NO: 760061 - RNA, 64 nt, Homo Sapiens; identical to SEQ ID NO: 86403

SEQ ID NO: 760062 - RNA, 64 nt, Homo Sapiens; identical to SEQ ID NO: 86404

SEQ ID NO: 760063 - RNA, 64 nt, Homo Sapiens; identical to SEQ ID NO: 86405

SEQ ID NO: 760064 - RNA, 64 nt, Homo Sapiens; identical to SEQ ID NO: 86406

SEQ ID NO: 760065 - RNA, 64 nt, Homo Sapiens; identical to SEQ ID NO: 86407

SEQ ID NO: 760066 - RNA, 64 nt, Homo Sapiens; identical to SEQ ID NO: 86408

SEQ ID NO: 760067 - RNA, 64 nt, Homo Sapiens; identical to SEQ ID NO: 86409

SEQ ID NO: 760068 - RNA, 64 nt, Homo Sapiens; identical to SEQ ID NO: 86410

SEQ ID NO: 760069 - RNA, 64 nt, Homo Sapiens; identical to SEQ ID NO: 86411

SEQ ID NO: 760070 - RNA, 64 nt, Homo Sapiens; identical to SEQ ID NO: 86412

SEQ ID NO: 760071 - RNA, 64 nt, Homo Sapiens; identical to SEQ ID NO: 86413

SEQ ID NO: 760072 - RNA, 64 nt, Homo Sapiens; identical to SEQ ID NO: 86414

SEQ ID NO: 760073 - RNA, 64 nt, Homo Sapiens; identical to SEQ ID NO: 86415

SEQ ID NO: 760074 - RNA, 64 nt, Homo Sapiens; identical to SEQ ID NO: 86416

SEQ ID NO: 760075 - RNA, 64 nt, Homo Sapiens; identical to SEQ ID NO: 86417

SEQ ID NO: 760076 - RNA, 64 nt, Homo Sapiens; identical to SEQ ID NO: 86418

SEQ ID NO: 760077 - RNA, 64 nt, Homo Sapiens; identical to SEQ ID NO: 86419

SEQ ID NO: 760078 - RNA, 64 nt, Homo Sapiens; identical to SEQ ID NO: 86420

SEQ ID NO: 760079 - RNA, 64 nt, Homo Sapiens; identical to SEQ ID NO: 86421

SEQ ID NO: 760080 - RNA, 64 nt, Homo Sapiens; identical to SEQ ID NO: 86422

SEQ ID NO: 760081 - RNA, 64 nt, Homo Sapiens; identical to SEQ ID NO: 86423

SEQ ID NO: 760082 - RNA, 64 nt, Homo Sapiens; identical to SEQ ID NO: 86424

SEQ ID NO: 760083 - RNA, 64 nt, Homo Sapiens; identical to SEQ ID NO: 86425

SEQ ID NO: 760084 - RNA, 64 nt, Homo Sapiens; identical to SEQ ID NO: 86426

SEQ ID NO: 760085 - RNA, 64 nt, Homo Sapiens; identical to SEQ ID NO: 86427

SEQ ID NO: 760086 - RNA, 64 nt, Homo Sapiens; identical to SEQ ID NO: 86428

SEQ ID NO: 760087 - RNA, 64 nt, Homo Sapiens; identical to SEQ ID NO: 86429

SEQ ID NO: 760088 - RNA, 64 nt, Homo Sapiens; identical to SEQ ID NO: 86430

SEQ ID NO: 760089 - RNA, 64 nt, Homo Sapiens; identical to SEQ ID NO: 86431

SEQ ID NO: 760090 - RNA, 64 nt, Homo Sapiens; identical to SEQ ID NO: 86432

SEQ ID NO: 760091 - RNA, 64 nt, Homo Sapiens; identical to SEQ ID NO: 86433

SEQ ID NO: 760092 - RNA, 64 nt, Homo Sapiens; identical to SEQ ID NO: 86434

SEQ ID NO: 760093 - RNA, 64 nt, Homo Sapiens; identical to SEQ ID NO: 86435

SEQ ID NO: 760094 - RNA, 64 nt, Homo Sapiens; identical to SEQ ID NO: 86436

SEQ ID NO: 760095 - RNA, 64 nt, Homo Sapiens; identical to SEQ ID NO: 86437

SEQ ID NO: 760096 - RNA, 64 nt, Homo Sapiens; identical to SEQ ID NO: 86438

SEQ ID NO: 760097 - RNA, 64 nt, Homo Sapiens; identical to SEQ ID NO: 86439

SEQ ID NO: 760098 - RNA, 64 nt, Homo Sapiens; identical to SEQ ID NO: 86440

SEQ ID NO: 760099 - RNA, 64 nt, Homo Sapiens; identical to SEQ ID NO: 86441

SEQ ID NO: 760100 - RNA, 64 nt, Homo Sapiens; identical to SEQ ID NO: 86442

SEQ ID NO: 760101 - RNA, 64 nt, Homo Sapiens; identical to SEQ ID NO: 86443

SEQ ID NO: 760102 - RNA, 64 nt, Homo Sapiens; identical to SEQ ID NO: 86444

SEQ ID NO: 760103 - RNA, 64 nt, Homo Sapiens; identical to SEQ ID NO: 86445

SEQ ID NO: 760104 - RNA, 60 nt, Homo Sapiens; identical to SEQ ID NO: 86446

SEQ ID NO: 760105 - RNA, 64 nt, Homo Sapiens; identical to SEQ ID NO: 86447

SEQ ID NO: 760106 - RNA, 64 nt, Homo Sapiens; identical to SEQ ID NO: 86448

SEQ ID NO: 760107 - RNA, 64 nt, Homo Sapiens; identical to SEQ ID NO: 86449

SEQ ID NO: 760108 - RNA, 64 nt, Homo Sapiens; identical to SEQ ID NO: 86450

SEQ ID NO: 760109 - RNA, 64 nt, Homo Sapiens; identical to SEQ ID NO: 86451

SEQ ID NO: 760110 - RNA, 64 nt, Homo Sapiens; identical to SEQ ID NO: 86452

SEQ ID NO: 760111 - RNA, 64 nt, Homo Sapiens; identical to SEQ ID NO: 86453

SEQ ID NO: 760112 - RNA, 64 nt, Homo Sapiens; identical to SEQ ID NO: 86454

SEQ ID NO: 760113 - RNA, 64 nt, Homo Sapiens; identical to SEQ ID NO: 86455

SEQ ID NO: 760114 - RNA, 64 nt, Homo Sapiens; identical to SEQ ID NO: 86456

SEQ ID NO: 760115 - RNA, 64 nt, Homo Sapiens; identical to SEQ ID NO: 86457

SEQ ID NO: 760116 - RNA, 64 nt, Homo Sapiens; identical to SEQ ID NO: 86458

SEQ ID NO: 760117 - RNA, 64 nt, Homo Sapiens; identical to SEQ ID NO: 86459

SEQ ID NO: 760118 - RNA, 64 nt, Homo Sapiens; identical to SEQ ID NO: 86460

SEQ ID NO: 760119 - RNA, 64 nt, Homo Sapiens; identical to SEQ ID NO: 86461

SEQ ID NO: 760120 - RNA, 55 nt, Homo Sapiens; identical to SEQ ID NO: 86462

SEQ ID NO: 760121 - RNA, 64 nt, Homo Sapiens; identical to SEQ ID NO: 86463

SEQ ID NO: 760122 - RNA, 64 nt, Homo Sapiens; identical to SEQ ID NO: 86464

SEQ ID NO: 760123 - RNA, 64 nt, Homo Sapiens; identical to SEQ ID NO: 86465

SEQ ID NO: 760124 - RNA, 64 nt, Homo Sapiens; identical to SEQ ID NO: 86466

SEQ ID NO: 760125 - RNA, 64 nt, Homo Sapiens; identical to SEQ ID NO: 86467

SEQ ID NO: 760126 - RNA, 64 nt, Homo Sapiens; identical to SEQ ID NO: 86468

SEQ ID NO: 760127 - RNA, 64 nt, Homo Sapiens; identical to SEQ ID NO: 86469

SEQ ID NO: 760128 - RNA, 64 nt, Homo Sapiens; identical to SEQ ID NO: 86470

SEQ ID NO: 760129 - RNA, 64 nt, Homo Sapiens; identical to SEQ ID NO: 86471

SEQ ID NO: 760130 - RNA, 64 nt, Homo Sapiens; identical to SEQ ID NO: 86472

SEQ ID NO: 760131 - RNA, 64 nt, Homo Sapiens; identical to SEQ ID NO: 86473

SEQ ID NO: 760132 - RNA, 64 nt, Homo Sapiens; identical to SEQ ID NO: 86474

SEQ ID NO: 760133 - RNA, 64 nt, Homo Sapiens; identical to SEQ ID NO: 86475

SEQ ID NO: 760134 - RNA, 64 nt, Homo Sapiens; identical to SEQ ID NO: 86476

SEQ ID NO: 760135 - RNA, 64 nt, Homo Sapiens; identical to SEQ ID NO: 86477

SEQ ID NO: 760136 - RNA, 64 nt, Homo Sapiens; identical to SEQ ID NO: 86478

SEQ ID NO: 760137 - RNA, 64 nt, Homo Sapiens; identical to SEQ ID NO: 86479

SEQ ID NO: 760138 - RNA, 64 nt, Homo Sapiens; identical to SEQ ID NO: 86480

SEQ ID NO: 760139 - RNA, 64 nt, Homo Sapiens; identical to SEQ ID NO: 86481

SEQ ID NO: 760140 - RNA, 64 nt, Homo Sapiens; identical to SEQ ID NO: 86482

SEQ ID NO: 760141 - RNA, 64 nt, Homo Sapiens; identical to SEQ ID NO: 86483

SEQ ID NO: 760142 - RNA, 64 nt, Homo Sapiens; identical to SEQ ID NO: 86484

SEQ ID NO: 760143 - RNA, 64 nt, Homo Sapiens; identical to SEQ ID NO: 86485

SEQ ID NO: 760144 - RNA, 64 nt, Homo Sapiens; identical to SEQ ID NO: 86486

SEQ ID NO: 760145 - RNA, 64 nt, Homo Sapiens; identical to SEQ ID NO: 86487

SEQ ID NO: 760146 - RNA, 64 nt, Homo Sapiens; identical to SEQ ID NO: 86488

SEQ ID NO: 760147 - RNA, 64 nt, Homo Sapiens; identical to SEQ ID NO: 86489

SEQ ID NO: 760148 - RNA, 64 nt, Homo Sapiens; identical to SEQ ID NO: 86490

SEQ ID NO: 760149 - RNA, 64 nt, Homo Sapiens; identical to SEQ ID NO: 86491

SEQ ID NO: 760150 - RNA, 64 nt, Homo Sapiens; identical to SEQ ID NO: 86492

SEQ ID NO: 760151 - RNA, 64 nt, Homo Sapiens; identical to SEQ ID NO: 86493

SEQ ID NO: 760152 - RNA, 51 nt, Homo Sapiens; identical to SEQ ID NO: 86494

SEQ ID NO: 760153 - RNA, 64 nt, Homo Sapiens; identical to SEQ ID NO: 86495

SEQ ID NO: 760154 - RNA, 64 nt, Homo Sapiens; identical to SEQ ID NO: 86496

SEQ ID NO: 760155 - RNA, 64 nt, Homo Sapiens; identical to SEQ ID NO: 86497

SEQ ID NO: 760156 - RNA, 64 nt, Homo Sapiens; identical to SEQ ID NO: 86498

SEQ ID NO: 760157 - RNA, 64 nt, Homo Sapiens; identical to SEQ ID NO: 86499

SEQ ID NO: 760158 - RNA, 64 nt, Homo Sapiens; identical to SEQ ID NO: 86500

SEQ ID NO: 760159 - RNA, 64 nt, Homo Sapiens; identical to SEQ ID NO: 86501

SEQ ID NO: 760160 - RNA, 64 nt, Homo Sapiens; identical to SEQ ID NO: 86502

SEQ ID NO: 760161 - RNA, 64 nt, Homo Sapiens; identical to SEQ ID NO: 86503

SEQ ID NO: 760162 - RNA, 64 nt, Homo Sapiens; identical to SEQ ID NO: 86504

SEQ ID NO: 760163 - RNA, 64 nt, Homo Sapiens; identical to SEQ ID NO: 86505

SEQ ID NO: 760164 - RNA, 64 nt, Homo Sapiens; identical to SEQ ID NO: 86506

SEQ ID NO: 760165 - RNA, 64 nt, Homo Sapiens; identical to SEQ ID NO: 86507

SEQ ID NO: 760166 - RNA, 64 nt, Homo Sapiens; identical to SEQ ID NO: 86508

SEQ ID NO: 760167 - RNA, 64 nt, Homo Sapiens; identical to SEQ ID NO: 86509

SEQ ID NO: 760168 - RNA, 64 nt, Homo Sapiens; identical to SEQ ID NO: 86510

SEQ ID NO: 760169 - RNA, 64 nt, Homo Sapiens; identical to SEQ ID NO: 86511

SEQ ID NO: 760170 - RNA, 64 nt, Homo Sapiens; identical to SEQ ID NO: 86512

SEQ ID NO: 760171 - RNA, 64 nt, Homo Sapiens; identical to SEQ ID NO: 86513

SEQ ID NO: 760172 - RNA, 64 nt, Homo Sapiens; identical to SEQ ID NO: 86514

SEQ ID NO: 760173 - RNA, 64 nt, Homo Sapiens; identical to SEQ ID NO: 86515

SEQ ID NO: 760174 - RNA, 64 nt, Homo Sapiens; identical to SEQ ID NO: 86516

SEQ ID NO: 760175 - RNA, 64 nt, Homo Sapiens; identical to SEQ ID NO: 86517

SEQ ID NO: 760176 - RNA, 64 nt, Homo Sapiens; identical to SEQ ID NO: 86518

SEQ ID NO: 760177 - RNA, 64 nt, Homo Sapiens; identical to SEQ ID NO: 86519

SEQ ID NO: 760178 - RNA, 64 nt, Homo Sapiens; identical to SEQ ID NO: 86520

SEQ ID NO: 760179 - RNA, 64 nt, Homo Sapiens; identical to SEQ ID NO: 86521

SEQ ID NO: 760180 - RNA, 64 nt, Homo Sapiens; identical to SEQ ID NO: 86522

SEQ ID NO: 760181 - RNA, 64 nt, Homo Sapiens; identical to SEQ ID NO: 86523

SEQ ID NO: 760182 - RNA, 64 nt, Homo Sapiens; identical to SEQ ID NO: 86524

SEQ ID NO: 760183 - RNA, 64 nt, Homo Sapiens; identical to SEQ ID NO: 86525

SEQ ID NO: 760184 - RNA, 64 nt, Homo Sapiens
gcgugaaucccgagggagccgguggcauacaccguuagcuuaaccuuagcuuaaacuagcugaa

SEQ ID NO: 760185 - RNA, 64 nt, Homo Sapiens
gagggagccgguggcauacaccguuagcuuaaccuuagcuuaaacuagcugaaggcuccugugc

SEQ ID NO: 760186 - RNA, 64 nt, Homo Sapiens
aagcacauugguauuguauaaagguauagagcacuuagcuuacaaucuuuaaagguuucucugc

SEQ ID NO: 760187 - RNA, 64 nt, Homo Sapiens
ucagaccaacugaggagcuuuccuuguuaacaauuuagcuuaucuuucuguuuccuuuauuuuu

SEQ ID NO: 760188 - RNA, 64 nt, Homo Sapiens
caccuacccacaugcacucgugugagacaaggcccauagguauggccccccccuucccccuccc

SEQ ID NO: 760189 - RNA, 64 nt, Homo Sapiens
gguuccagugagcgguguguugagccuaguagagcauagguacuugggguugccaaaaccccag

SEQ ID NO: 760190 - RNA, 64 nt, Homo Sapiens
ccagcaggucccuuuuugucucucaugggccuagcauagguaugagccagggauccuuuccugg

SEQ ID NO: 760191 - RNA, 64 nt, Homo Sapiens
uuacaguaauccacugagauguaguuuagucaaacauagguauaugaacuguuaaucuuggugg

SEQ ID NO: 760192 - RNA, 64 nt, Homo Sapiens
cgcugcagccagcaguuguaaaauuguuaguaaacauagguauaauuaccagauaguuauauua

SEQ ID NO: 760193 - RNA, 64 nt, Homo Sapiens
uguagaaucuaaguuaaacuuacuauuuauaaugcauagguaaccauuaacuauguacauauaa

SEQ ID NO: 760194 - RNA, 64 nt, Homo Sapiens
cccacagaaggaggaaguggaagggacaggagcacauagguagaugccaaguuaugcagcuguu

SEQ ID NO: 760195 - RNA, 64 nt, Homo Sapiens
uauggugaguucaaccauuuggcuggaaugaccacauagguaggaguaaccuggacggcucuaa

SEQ ID NO: 760196 - RNA, 64 nt, Homo Sapiens
caauguacaugggaggccacauaggauacuuguacauagguaaccccugcuguuuuacuggugu

SEQ ID NO: 760197 - RNA, 64 nt, Homo Sapiens
cugcaugucauggggguuuggugcagguuuguuacauagguaaauuuuagauucagggguauau

SEQ ID NO: 760198 - RNA, 64 nt, Homo Sapiens
aguuauaucaagcuuaauauaucaucgucaucaucauagguaacguacaguuaucauuaucauc

SEQ ID NO: 760199 - RNA, 64 nt, Homo Sapiens
uaaacugggugaagccacaccuacacuuccacuccauagguaaauaagcagaccuuauuucucc

SEQ ID NO: 760200 - RNA, 64 nt, Homo Sapiens
gcuggcuccaggugaagacuguaacuagaaaguccauagguaguaaaaggauuuauugguucau

SEQ ID NO: 760201 - RNA, 64 nt, Homo Sapiens
ugguaaagagaaugaggagaggcuuggagggucacauagguagacaggggagaaauagcagagg

SEQ ID NO: 760202 - RNA, 64 nt, Homo Sapiens
cuuacuacuugggccucuuuuuuguagcaagagccauagguagccacaucagacuggcaacugu

SEQ ID NO: 760203 - RNA, 64 nt, Homo Sapiens
uccuccuauuugccacugggcuguugguuagaagcauagguaacugauuaaguagguaugauac

SEQ ID NO: 760204 - RNA, 64 nt, Homo Sapiens
cagcaucuguaugauauaguggagcaggugcugacauagguaccagcugacaugaugugucacu

SEQ ID NO: 760205 - RNA, 64 nt, Homo Sapiens
ucaagcaacacaauaaaaagacauacuugcauuacauagguacuuauagguauuuuaguacagu

SEQ ID NO: 760206 - RNA, 64 nt, Homo Sapiens
aucccuuaggagcgaagaguagcuccugauuccccauagguaacguauaccaucuucuauuucc

SEQ ID NO: 760207 - RNA, 64 nt, Homo Sapiens
uuuuacucuaucugugauacaauaugugagggugcauagguauuucuguaauacaaggauucaa

SEQ ID NO: 760208 - RNA, 64 nt, Homo Sapiens
gguuagggguuaggggcuaguuuuggauuugauucauagguaggagggcuuagauuuuaaggca

SEQ ID NO: 760209 - RNA, 64 nt, Homo Sapiens
cauggugagggcuaucugcugggcugcccugccucauagguagccagcagggcuggcugccaca

SEQ ID NO: 760210 - RNA, 64 nt, Homo Sapiens
uuacguuuuuuaaaugcuuuauuucaauaggaugcauagguauaagaaaauucuaauauaaagc

SEQ ID NO: 760211 - RNA, 64 nt, Homo Sapiens
aguauguauauauguguaugcucagauuaacuuccauagguacauaagugaaagaagucucagu

SEQ ID NO: 760212 - RNA, 64 nt, Homo Sapiens
uuguuauaaagcauuuguuuguuaguaucaaucacauagguagaaagaguuugaguuuuacugu

SEQ ID NO: 760213 - RNA, 64 nt, Homo Sapiens
ucuuccuuucuucccaaugucuauuaagaucacacauagguaaacuguuacaaauccagaaugg

SEQ ID NO: 760214 - RNA, 64 nt, Homo Sapiens
acucgcaaacacaguucaaggaacaggcuuacaacauagguaaagaccaauuuaaaaugcuagg

SEQ ID NO: 760215 - RNA, 64 nt, Homo Sapiens
gugugcacuuuauguguacauuggcauuguucagcauagguaaugcaucaauauauuauguuuc

SEQ ID NO: 760216 - RNA, 64 nt, Homo Sapiens
augucauuaguucaaauucuuuagugagaugugucauagguauuuucuuuuauuguucaaucug

SEQ ID NO: 760217 - RNA, 64 nt, Homo Sapiens
auuuauuccaucuucacuaaaauagaagcaauuccauagguaccauaaaccuauuuuagguacc

SEQ ID NO: 760218 - RNA, 64 nt, Homo Sapiens
caucauacucagggguuagcuuccaaggucaguacauagguaaaaugggcuauuaggaugaucc

SEQ ID NO: 760219 - RNA, 64 nt, Homo Sapiens
aggauuuauuugaaaauggugggauucauuggcccauagguacauuggaaaauguauaucucuc

SEQ ID NO: 760220 - RNA, 64 nt, Homo Sapiens
caauauucagugaccauaguugacuuuuacauuccauagguauuuuauuuuguggcauuuccau

SEQ ID NO: 760221 - RNA, 64 nt, Homo Sapiens
uauccuuccauuuuggccuccugaguagcuagaccauagguaugcaucaccacacccugcuaau

SEQ ID NO: 760222 - RNA, 64 nt, Homo Sapiens
uucuguuuuguaaugaccaaaggaaugaggcugacauagguauauauauauauuuuuuuccuuu

SEQ ID NO: 760223 - RNA, 64 nt, Homo Sapiens
uuuuucuaaaaacuucaaguaagcugcaauguaacauagguaucugaugagccugcauaaagug

SEQ ID NO: 760224 - RNA, 64 nt, Homo Sapiens
cucaguaacacagaacgaaauugaaugaaugucacauagguaucuucauuaggaacuuuuuugu

SEQ ID NO: 760225 - RNA, 64 nt, Homo Sapiens
ucaaaacacaucuuuccugucuuccagaauugaucauagguauuagcucaagcaggaaguucaa

SEQ ID NO: 760226 - RNA, 64 nt, Homo Sapiens
uauugauuggaggaagggagaaguugauuguaaccauagguauuaacaucuuaugauuuagagu

SEQ ID NO: 760227 - RNA, 64 nt, Homo Sapiens
gggaaguccauuugcaagcuaacccuucauuccucauagguacuuggcucaggacggguaugga

SEQ ID NO: 760228 - RNA, 64 nt, Homo Sapiens
ucaugcugaaugaagcguaggaacuugacaagcccauagguagcuauaguucuuugucaguaua

SEQ ID NO: 760229 - RNA, 64 nt, Homo Sapiens
uaccuugguaggagggagucaguacuguuggacccauagguagccucaucccugccacuguguu

SEQ ID NO: 760230 - RNA, 64 nt, Homo Sapiens
ugagaacugaggacauuauggcucucauaaucugcauagguauaaagaggaucauuucuaccua

SEQ ID NO: 760231 - RNA, 64 nt, Homo Sapiens
aaaaucucaaucuugaaaaucaagcuugaaauuucauagguagaaauauuagcauuuuuauuga

SEQ ID NO: 760232 - RNA, 64 nt, Homo Sapiens
aagccuugauuggauuuugguuuaggaaaaaucucauagguauaaaagacaacugggaauguug

SEQ ID NO: 760233 - RNA, 64 nt, Homo Sapiens
uaucuuuauaguuguagacuacuuuuuaaacucacauagguagguuauuucuuuugugcagauc

SEQ ID NO: 760234 - RNA, 64 nt, Homo Sapiens
cuugugucauggggguuuacgugcagguuuguuacauagguaaauuuuaaguucaaggguacau

SEQ ID NO: 760235 - RNA, 64 nt, Homo Sapiens
uauuuuucuuuauuaagcuuaaaauugugcaaagcauagguaaacgucucaaaaaaaaaaaaag

SEQ ID NO: 760236 - RNA, 64 nt, Homo Sapiens
uuccaguuacucuucccacauggggucaagagagcauagguagggugagggguuuuggggaguu

SEQ ID NO: 760237 - RNA, 64 nt, Homo Sapiens
caguucuuugggacuuuugguccugagagcgccucauagguagaccgugaucacacgucccagg

SEQ ID NO: 760238 - RNA, 64 nt, Homo Sapiens
gguggaccuaaauuccuuauuuuauguuuauuaucauagguauacuuaaauuguuuugcagucu

SEQ ID NO: 760239 - RNA, 64 nt, Homo Sapiens
auguaaagcuugucugaucgcaauuucugaacaccauagguagaugauauuucaauguuagccu

SEQ ID NO: 760240 - RNA, 64 nt, Homo Sapiens
uuguccaaggucucaugaccugaggcuuaaugagcauagguagcgagaugucaagaaguuaaau

SEQ ID NO: 760241 - RNA, 64 nt, Homo Sapiens
uugaaaaugcugcacaucccuuaauagucaucuacauagguaauacugauaaacauuuuguauu

SEQ ID NO: 760242 - RNA, 64 nt, Homo Sapiens
aguucucuaauauucuuaguaccacaagauaugucauagguaucuuuaaaugaaauucuuagcu

SEQ ID NO: 760243 - RNA, 64 nt, Homo Sapiens
uuuacuaaaagguucauugguuccaaucacagcucauagguagagcaaagaaaggguggaugga

SEQ ID NO: 760244 - RNA, 64 nt, Homo Sapiens
cacuuagucuugccugucaaaaaguccaacauuucauagguaguaggggccacauauuacauuc

SEQ ID NO: 760245 - RNA, 64 nt, Homo Sapiens
aauaauaaaagccucaaugcgguauuccuugagucauagguauuccccaaagcaccccaaggcu

SEQ ID NO: 760246 - RNA, 64 nt, Homo Sapiens
uuuaggugccauuagguauuaacaagaaaagaagcauagguacuagacuuucacggauucaugg

SEQ ID NO: 760247 - RNA, 64 nt, Homo Sapiens
acauuuaucauuugugacaguaugauuuuuacuacauagguagcgacuuggcuuauaauaguuu

SEQ ID NO: 760248 - RNA, 64 nt, Homo Sapiens
uuuacguguggcuacaacaagaucacauucauuccauagguagccacagcucaaagauaacagu

SEQ ID NO: 760249 - RNA, 64 nt, Homo Sapiens
uagugugacacuucugacuuuagcuaguucuaggcauagguacgacuuccuuugauaugcugca

SEQ ID NO: 760250 - RNA, 64 nt, Homo Sapiens
uaaguugauguuuaaaauugagaaauacuuuugucauagguaauuuggaacauuuacaagccau

SEQ ID NO: 760251 - RNA, 64 nt, Homo Sapiens
ccagggcacugcagagucugggcagaggugggcgcauagguacaagugcugcuuugucagccuc

SEQ ID NO: 760252 - RNA, 64 nt, Homo Sapiens
gacagaugccuuaaugugaaauccaaaucuuuuucauagguaauuguauauuccuuuguuuuga

SEQ ID NO: 760253 - RNA, 64 nt, Homo Sapiens
agccaucauaccuaagucuuuugccaaaaccucucauagguauaucuagcugaacuuauuuugg

SEQ ID NO: 760254 - RNA, 64 nt, Homo Sapiens
ugaugauuugcaagagaaaauuaguggagagucacauagguaaaucauuauuuaacuuagguuu

SEQ ID NO: 760255 - RNA, 64 nt, Homo Sapiens
cuagaaguucuugauucauuuuuaccauucuuuccauagguagaagagaaaguugauugguugg

SEQ ID NO: 760256 - RNA, 64 nt, Homo Sapiens
uacuucaaauggcacauagauaggcaggauauuacauagguaagcaggaauuuauacauugggu

SEQ ID NO: 760257 - RNA, 64 nt, Homo Sapiens
acaugaaauuaucauaugacccagcaauucuacucauagguauauacuuaaaagaaaugaaaaa

SEQ ID NO: 760258 - RNA, 64 nt, Homo Sapiens
acaguaucaacccucccaguugcuuaauuauacccauagguaauacaaaaagcucugaagaccc

SEQ ID NO: 760259 - RNA, 64 nt, Homo Sapiens
uguguacacaaaggauuugaugcuuuucucucagcauagguaugcuuacuaugaccuuccaagu

SEQ ID NO: 760260 - RNA, 64 nt, Homo Sapiens
uuaacaggcauuaaaauuuguucucagcuucucccauagguaguaaagugcauuugccuaggac

SEQ ID NO: 760261 - RNA, 64 nt, Homo Sapiens
accucagaggauggcuuugcguuccagccugcagcauagguacgcuagaaagcaguuuuaggag

SEQ ID NO: 760262 - RNA, 64 nt, Homo Sapiens
gguucucagugacacaagaauucaguauuaaguacauagguauuuacuauggaguauaauucuc

SEQ ID NO: 760263 - RNA, 64 nt, Homo Sapiens
aagauccacaaaugaagggauauaaaaauaaugucauagguaagaaacacagcaacaaugacuu

SEQ ID NO: 760264 - RNA, 64 nt, Homo Sapiens
auauaagaacuguacucuucucagcuugagcuuacauagguaaauaucaccaacaucuguccuu

SEQ ID NO: 760265 - RNA, 64 nt, Homo Sapiens
ucuuaaaccaggugaaagagagagccuucccacccauagguagucauuuguauauaacacuuuc

SEQ ID NO: 760266 - RNA, 64 nt, Homo Sapiens
agacaaccaauacaugcagguacugcugugaggccauagguacuuuaucccaauaaguuauugc

SEQ ID NO: 760267 - RNA, 64 nt, Homo Sapiens
uugucccucucacuaaaaagcuuugaucaugagacauagguaucuauuuaagaauaaaagagua

SEQ ID NO: 760268 - RNA, 64 nt, Homo Sapiens
uuaaugguucaaaaaaaaucuuucuuauaaagagcauagguagaauuagugaacucuuuggauc

SEQ ID NO: 760269 - RNA, 64 nt, Homo Sapiens
caacuuauuguaucugaauuccuguagcacaccucauagguaugauuuuuuuaaauuaaagaau

SEQ ID NO: 760270 - RNA, 64 nt, Homo Sapiens
guugucuccuuuaagcuuuccugggucuaaccuacauagguaauuuaagaacauccucagaaag

SEQ ID NO: 760271 - RNA, 64 nt, Homo Sapiens
cguuuuguuuguuuuucuaugauaauuuaaaauacauagguagggcuacugaggaaauuuggag

SEQ ID NO: 760272 - RNA, 64 nt, Homo Sapiens
uagaucauugcauuuguuuuacaccagcuggcgucauagguagccaucuucgcuacaaccacug

SEQ ID NO: 760273 - RNA, 64 nt, Homo Sapiens
cugugccuucagcuguugcaguucuuuccaugggcauagguaagacaaaugaauuuuccacgca

SEQ ID NO: 760274 - RNA, 64 nt, Homo Sapiens
auucaguuguuggcuuguuuugccacccacuggccauagguacaaagccucaaauguauuuuag

SEQ ID NO: 760275 - RNA, 64 nt, Homo Sapiens
aacaaauacuugacucaguggcccgacauuucuucauagguagauacaucuugggaguacaaug

SEQ ID NO: 760276 - RNA, 64 nt, Homo Sapiens
gauuauauaaaauacauaauuaaaaucuguaaaccauagguaauagagauauguaucauaaaaa

SEQ ID NO: 760277 - RNA, 64 nt, Homo Sapiens
uucaaauguuaaguaaaacaagaugugccaauaucauagguaaauaaauuagggaaaauguggg

SEQ ID NO: 760278 - RNA, 64 nt, Homo Sapiens
aaagaaaaaagcaaguauugcauaggcaccugagcauagguaugaccuugggaagacauuggcu

SEQ ID NO: 760279 - RNA, 64 nt, Homo Sapiens
uacucacuuaaaaucaagaaucccaucuaaaacacauagguaccuuaucugaaacucuugcacu

SEQ ID NO: 760280 - RNA, 64 nt, Homo Sapiens
agugaggccgugucauuggcucacaaaagugacucauagguaauuucuguguuugcauuccacu

SEQ ID NO: 760281 - RNA, 64 nt, Homo Sapiens
uauaugccaugauggaaauagugcagguuuguuacauagguauaucaggauacaugugccgaau

SEQ ID NO: 760282 - RNA, 64 nt, Homo Sapiens
guuguugagcaguugagcaacuuuucacuuuugacauagguaauaucuuuacaauacuuuuuau

SEQ ID NO: 760283 - RNA, 64 nt, Homo Sapiens
agcccacggagauccuaagcucagcccucugugacauagguagcggaacacugcaagcccuuaa

SEQ ID NO: 760284 - RNA, 64 nt, Homo Sapiens
ugucuuuaagaacuaauucguacauaauaaguuucauagguaacacauuauuugaaguuacagc

SEQ ID NO: 760285 - RNA, 64 nt, Homo Sapiens
ugcuaugacuacccuccuuugaucuauuuuuggucauagguaaaaaaaaaaaucucucuuggga

SEQ ID NO: 760286 - RNA, 64 nt, Homo Sapiens
guuagcucagucaguccucaucgugguccugaggcauagguacuguuguaccaaggucacuuau

SEQ ID NO: 760287 - RNA, 64 nt, Homo Sapiens
aauccauaguuaaauugcacguagauauuauagccauagguaaaucuuguguuaugaaaggcag

SEQ ID NO: 760288 - RNA, 64 nt, Homo Sapiens
uccuuaauggugcuuucuccgcuauagaagcuggcauagguauacugccaauaaagcaggugca

SEQ ID NO: 760289 - RNA, 64 nt, Homo Sapiens
aucuuucaccaaguaaauuucagaaucaucauaucauagguacagaacuauauuuucccccaau

SEQ ID NO: 760290 - RNA, 64 nt, Homo Sapiens
ucucccacagaaaugaugaaaaaugcaucacuuacauagguauucugcauguuuuauaauuuca

SEQ ID NO: 760291 - RNA, 64 nt, Homo Sapiens
aaagggcuggcccuucagauugcuggugaggugucauagguagagagguccugugcccuuuacu

SEQ ID NO: 760292 - RNA, 64 nt, Homo Sapiens
guaucacugcagucaccucuucuacccucaucaucauagguaagguuuucaagguggcaauugg

SEQ ID NO: 760293 - RNA, 64 nt, Homo Sapiens
uacgugcuuugugcauuguagucuagucguaauucauagguacugacuccucagccccaaaugu

SEQ ID NO: 760294 - RNA, 64 nt, Homo Sapiens
uggccuuggccuucaucccacagugguuguuccucauagguaggucuggaacguuccagccagg

SEQ ID NO: 760295 - RNA, 64 nt, Homo Sapiens
uucucauugccagauuccauuacccuuucuuccucauagguaguaauuaccaauguaacuaagc

SEQ ID NO: 760296 - RNA, 64 nt, Homo Sapiens
ggaaagagccuuguaucauaugugaacauuguaucauagguaauguuguacagacccuuuuaua

SEQ ID NO: 760297 - RNA, 64 nt, Homo Sapiens
uauuuccuacuguguaggagaauuugcagucagccauagguauguaggaauagucacucacugg

SEQ ID NO: 760298 - RNA, 64 nt, Homo Sapiens
agggagguggccagcgcccccgggcacugcugcucauagguaccuuuccacugccuccucccug

SEQ ID NO: 760299 - RNA, 64 nt, Homo Sapiens
aauuaccaguguaacuaagcuacacuuucuuccucauagguagucauuaauugucagauuccac

SEQ ID NO: 760300 - RNA, 64 nt, Homo Sapiens
ucugaacaacugccgcaagaccccaggaaggggccauagguagggggucaaaccacugccuugg

SEQ ID NO: 760301 - RNA, 64 nt, Homo Sapiens
ggaggaagcgaaggaagugauucccccgcuaugucauagguaguccucucucaugguugucucu

SEQ ID NO: 760302 - RNA, 64 nt, Homo Sapiens
auucuaauuccaugguaaauaucuaguggaagaacauagguaucacagaucucuuaauaaguga

SEQ ID NO: 760303 - RNA, 64 nt, Homo Sapiens
uguaaguaaucugaaagcaauagugcaugaauuucauagguaguguuguuuuaggucaguaaau

SEQ ID NO: 760304 - RNA, 64 nt, Homo Sapiens
gugagaagaguauguggccucuuuguuacugagucauagguauuugcugagauuugcuauuagg

SEQ ID NO: 760305 - RNA, 64 nt, Homo Sapiens
uauacacauauguguguugaauaauuacuauuggcauagguauguguauacacacggugcacca

SEQ ID NO: 760306 - RNA, 64 nt, Homo Sapiens
ccagggcacauguacaggaccugcagcuuuguuacauagguaggcuugugccauggugguuugc

SEQ ID NO: 760307 - RNA, 64 nt, Homo Sapiens
cuggcagauuuggugucugaugggguauguucuucauagguagugcuugugucuugaugugugu

SEQ ID NO: 760308 - RNA, 64 nt, Homo Sapiens
ccugugccauggugguuugccugcagguuuguuacauagguaagccgggauacaugugcaggac

SEQ ID NO: 760309 - RNA, 64 nt, Homo Sapiens
cuuuuuuuuucuucuuaccaucauuuaugcaugacauagguaaugugacuaauuucuccaguug

SEQ ID NO: 760310 - RNA, 64 nt, Homo Sapiens
gguccuggcccuccucccccaucugcacccccaucauagguagagaccccacccucccaucggu

SEQ ID NO: 760311 - RNA, 64 nt, Homo Sapiens
uaacaacacaggugacucuuucccuugauaaagucauagguaauucaggggcugggugcggcgg

SEQ ID NO: 760312 - RNA, 64 nt, Homo Sapiens
ugaaguauuguguauaaaaauaccugucuuauuucauagguacauuugcacuggacauauuccc

SEQ ID NO: 760313 - RNA, 64 nt, Homo Sapiens
ugaaguauuguguauaaaaauaccuguuuuauuucauagguacauuugcacuggacauauuccc

SEQ ID NO: 760314 - RNA, 64 nt, Homo Sapiens
cauuuagaaaggacagaaaauauuuaaaguggcucauagguaaugaauauuucugacuuagaug

SEQ ID NO: 760315 - RNA, 64 nt, Homo Sapiens
aacugcugucauuauugauuucaguaacaucuuccauagguauauaaauauuagauuaugaugu

SEQ ID NO: 760316 - RNA, 64 nt, Homo Sapiens
gccucuuguuccuaggcaugccugacccaucccgcauagguagaauccuguuggcuuuggguuu

SEQ ID NO: 760317 - RNA, 64 nt, Homo Sapiens
gaaaagauaaacuaacuuguaagcuauuuuacuacauagguaaauacuaaggauaaagcuuuag

SEQ ID NO: 760318 - RNA, 64 nt, Homo Sapiens
uauauuagcucauucauuccucacaauucuacaacauagguaucauuccaaccucuauuuuaca

SEQ ID NO: 760319 - RNA, 64 nt, Homo Sapiens; identical to SEQ ID NO: 110389

SEQ ID NO: 760320 - RNA, 64 nt, Homo Sapiens; identical to SEQ ID NO: 110390

SEQ ID NO: 760321 - RNA, 64 nt, Homo Sapiens; identical to SEQ ID NO: 110391

SEQ ID NO: 760322 - RNA, 64 nt, Homo Sapiens; identical to SEQ ID NO: 110392

SEQ ID NO: 760323 - RNA, 64 nt, Homo Sapiens; identical to SEQ ID NO: 110393

SEQ ID NO: 760324 - RNA, 63 nt, Homo Sapiens; identical to SEQ ID NO: 110394

SEQ ID NO: 760325 - RNA, 60 nt, Homo Sapiens; identical to SEQ ID NO: 110395

SEQ ID NO: 760326 - RNA, 64 nt, Homo Sapiens; identical to SEQ ID NO: 110396

SEQ ID NO: 760327 - RNA, 64 nt, Homo Sapiens; identical to SEQ ID NO: 110397

SEQ ID NO: 760328 - RNA, 64 nt, Homo Sapiens; identical to SEQ ID NO: 110398

SEQ ID NO: 760329 - RNA, 64 nt, Homo Sapiens; identical to SEQ ID NO: 110399

SEQ ID NO: 760330 - RNA, 64 nt, Homo Sapiens; identical to SEQ ID NO: 110400

SEQ ID NO: 760331 - RNA, 64 nt, Homo Sapiens; identical to SEQ ID NO: 110401

SEQ ID NO: 760332 - RNA, 58 nt, Homo Sapiens; identical to SEQ ID NO: 110402

SEQ ID NO: 760333 - RNA, 64 nt, Homo Sapiens; identical to SEQ ID NO: 110403

SEQ ID NO: 760334 - RNA, 64 nt, Homo Sapiens; identical to SEQ ID NO: 110404

SEQ ID NO: 760335 - RNA, 64 nt, Homo Sapiens; identical to SEQ ID NO: 110405

SEQ ID NO: 760336 - RNA, 64 nt, Homo Sapiens; identical to SEQ ID NO: 110406

SEQ ID NO: 760337 - RNA, 64 nt, Homo Sapiens; identical to SEQ ID NO: 110407

SEQ ID NO: 760338 - RNA, 64 nt, Homo Sapiens; identical to SEQ ID NO: 110408

SEQ ID NO: 760339 - RNA, 64 nt, Homo Sapiens; identical to SEQ ID NO: 110409

SEQ ID NO: 760340 - RNA, 64 nt, Homo Sapiens; identical to SEQ ID NO: 110410

SEQ ID NO: 760341 - RNA, 64 nt, Homo Sapiens; identical to SEQ ID NO: 110411

SEQ ID NO: 760342 - RNA, 64 nt, Homo Sapiens; identical to SEQ ID NO: 110412

SEQ ID NO: 760343 - RNA, 64 nt, Homo Sapiens; identical to SEQ ID NO: 110413

SEQ ID NO: 760344 - RNA, 64 nt, Homo Sapiens; identical to SEQ ID NO: 110414

SEQ ID NO: 760345 - RNA, 64 nt, Homo Sapiens; identical to SEQ ID NO: 110415

SEQ ID NO: 760346 - RNA, 64 nt, Homo Sapiens; identical to SEQ ID NO: 110416

SEQ ID NO: 760347 - RNA, 64 nt, Homo Sapiens; identical to SEQ ID NO: 110417

SEQ ID NO: 760348 - RNA, 64 nt, Homo Sapiens; identical to SEQ ID NO: 110418

SEQ ID NO: 760349 - RNA, 64 nt, Homo Sapiens; identical to SEQ ID NO: 110419

SEQ ID NO: 760350 - RNA, 64 nt, Homo Sapiens; identical to SEQ ID NO: 110420

SEQ ID NO: 760351 - RNA, 64 nt, Homo Sapiens; identical to SEQ ID NO: 110421

SEQ ID NO: 760352 - RNA, 64 nt, Homo Sapiens; identical to SEQ ID NO: 110422

SEQ ID NO: 760353 - RNA, 64 nt, Homo Sapiens; identical to SEQ ID NO: 110423

SEQ ID NO: 760354 - RNA, 64 nt, Homo Sapiens; identical to SEQ ID NO: 110424

SEQ ID NO: 760355 - RNA, 64 nt, Homo Sapiens; identical to SEQ ID NO: 110425

SEQ ID NO: 760356 - RNA, 64 nt, Homo Sapiens; identical to SEQ ID NO: 110426

SEQ ID NO: 760357 - RNA, 64 nt, Homo Sapiens; identical to SEQ ID NO: 110427

SEQ ID NO: 760358 - RNA, 64 nt, Homo Sapiens; identical to SEQ ID NO: 110428

SEQ ID NO: 760359 - RNA, 64 nt, Homo Sapiens; identical to SEQ ID NO: 110429

SEQ ID NO: 760360 - RNA, 64 nt, Homo Sapiens; identical to SEQ ID NO: 110430

SEQ ID NO: 760361 - RNA, 64 nt, Homo Sapiens; identical to SEQ ID NO: 110431

SEQ ID NO: 760362 - RNA, 64 nt, Homo Sapiens; identical to SEQ ID NO: 110432

SEQ ID NO: 760363 - RNA, 64 nt, Homo Sapiens; identical to SEQ ID NO: 110433

SEQ ID NO: 760364 - RNA, 64 nt, Homo Sapiens; identical to SEQ ID NO: 110434

SEQ ID NO: 760365 - RNA, 64 nt, Homo Sapiens; identical to SEQ ID NO: 110435

SEQ ID NO: 760366 - RNA, 64 nt, Homo Sapiens; identical to SEQ ID NO: 110436

SEQ ID NO: 760367 - RNA, 64 nt, Homo Sapiens; identical to SEQ ID NO: 110437

SEQ ID NO: 760368 - RNA, 64 nt, Homo Sapiens; identical to SEQ ID NO: 110438

SEQ ID NO: 760369 - RNA, 64 nt, Homo Sapiens; identical to SEQ ID NO: 110439

SEQ ID NO: 760370 - RNA, 64 nt, Homo Sapiens; identical to SEQ ID NO: 607606

SEQ ID NO: 760371 - RNA, 64 nt, Homo Sapiens; identical to SEQ ID NO: 607607

SEQ ID NO: 760372 - RNA, 64 nt, Homo Sapiens; identical to SEQ ID NO: 607608

SEQ ID NO: 760373 - RNA, 64 nt, Homo Sapiens; identical to SEQ ID NO: 607609

SEQ ID NO: 760374 - RNA, 64 nt, Homo Sapiens; identical to SEQ ID NO: 607610

SEQ ID NO: 760375 - RNA, 64 nt, Homo Sapiens; identical to SEQ ID NO: 607611

SEQ ID NO: 760376 - RNA, 64 nt, Homo Sapiens; identical to SEQ ID NO: 607612

SEQ ID NO: 760377 - RNA, 64 nt, Homo Sapiens; identical to SEQ ID NO: 607613

SEQ ID NO: 760378 - RNA, 64 nt, Homo Sapiens; identical to SEQ ID NO: 607614

SEQ ID NO: 760379 - RNA, 64 nt, Homo Sapiens; identical to SEQ ID NO: 607615

SEQ ID NO: 760380 - RNA, 64 nt, Homo Sapiens
cuuuuguguucagaguuaaauggaacaguagcaaauucacuaaacauuuuuaauuguccuguaa

SEQ ID NO: 760381 - RNA, 64 nt, Homo Sapiens
guauagaagaugcuguuaaaaacaauuagaauucauucacuauuaugugaauuaaaaauuuugg

SEQ ID NO: 760382 - RNA, 64 nt, Homo Sapiens; identical to SEQ ID NO: 71798

SEQ ID NO: 760383 - RNA, 64 nt, Homo Sapiens; identical to SEQ ID NO: 71799

SEQ ID NO: 760384 - RNA, 64 nt, Homo Sapiens; identical to SEQ ID NO: 71800

SEQ ID NO: 760385 - RNA, 64 nt, Homo Sapiens; identical to SEQ ID NO: 71801

SEQ ID NO: 760386 - RNA, 64 nt, Homo Sapiens; identical to SEQ ID NO: 71802

SEQ ID NO: 760387 - RNA, 64 nt, Homo Sapiens; identical to SEQ ID NO: 71803

SEQ ID NO: 760388 - RNA, 64 nt, Homo Sapiens; identical to SEQ ID NO: 71804

SEQ ID NO: 760389 - RNA, 64 nt, Homo Sapiens; identical to SEQ ID NO: 71805

SEQ ID NO: 760390 - RNA, 64 nt, Homo Sapiens; identical to SEQ ID NO: 71806

SEQ ID NO: 760391 - RNA, 64 nt, Homo Sapiens; identical to SEQ ID NO: 71807

SEQ ID NO: 760392 - RNA, 64 nt, Homo Sapiens; identical to SEQ ID NO: 71808

SEQ ID NO: 760393 - RNA, 64 nt, Homo Sapiens; identical to SEQ ID NO: 71809

SEQ ID NO: 760394 - RNA, 64 nt, Homo Sapiens; identical to SEQ ID NO: 71810

SEQ ID NO: 760395 - RNA, 64 nt, Homo Sapiens; identical to SEQ ID NO: 71811

SEQ ID NO: 760396 - RNA, 64 nt, Homo Sapiens; identical to SEQ ID NO: 154250

SEQ ID NO: 760397 - RNA, 64 nt, Homo Sapiens; identical to SEQ ID NO: 154251

SEQ ID NO: 760398 - RNA, 64 nt, Homo Sapiens; identical to SEQ ID NO: 154252

SEQ ID NO: 760399 - RNA, 64 nt, Homo Sapiens; identical to SEQ ID NO: 154253

SEQ ID NO: 760400 - RNA, 64 nt, Homo Sapiens; identical to SEQ ID NO: 154254

SEQ ID NO: 760401 - RNA, 64 nt, Homo Sapiens; identical to SEQ ID NO: 154255

SEQ ID NO: 760402 - RNA, 64 nt, Homo Sapiens; identical to SEQ ID NO: 154256

SEQ ID NO: 760403 - RNA, 64 nt, Homo Sapiens; identical to SEQ ID NO: 154257

SEQ ID NO: 760404 - RNA, 64 nt, Homo Sapiens; identical to SEQ ID NO: 154258

SEQ ID NO: 760405 - RNA, 64 nt, Homo Sapiens; identical to SEQ ID NO: 154259

SEQ ID NO: 760406 - RNA, 64 nt, Homo Sapiens; identical to SEQ ID NO: 154260

SEQ ID NO: 760407 - RNA, 64 nt, Homo Sapiens; identical to SEQ ID NO: 154261

SEQ ID NO: 760408 - RNA, 64 nt, Homo Sapiens; identical to SEQ ID NO: 154262

SEQ ID NO: 760409 - RNA, 64 nt, Homo Sapiens; identical to SEQ ID NO: 154263

SEQ ID NO: 760410 - RNA, 64 nt, Homo Sapiens; identical to SEQ ID NO: 154264

SEQ ID NO: 760411 - RNA, 64 nt, Homo Sapiens; identical to SEQ ID NO: 154265

SEQ ID NO: 760412 - RNA, 64 nt, Homo Sapiens; identical to SEQ ID NO: 154266

SEQ ID NO: 760413 - RNA, 64 nt, Homo Sapiens; identical to SEQ ID NO: 154267

SEQ ID NO: 760414 - RNA, 64 nt, Homo Sapiens; identical to SEQ ID NO: 154268

SEQ ID NO: 760415 - RNA, 64 nt, Homo Sapiens; identical to SEQ ID NO: 154269

SEQ ID NO: 760416 - RNA, 64 nt, Homo Sapiens; identical to SEQ ID NO: 154270

SEQ ID NO: 760417 - RNA, 64 nt, Homo Sapiens; identical to SEQ ID NO: 154271

SEQ ID NO: 760418 - RNA, 64 nt, Homo Sapiens; identical to SEQ ID NO: 154272

SEQ ID NO: 760419 - RNA, 64 nt, Homo Sapiens; identical to SEQ ID NO: 154273

SEQ ID NO: 760420 - RNA, 64 nt, Homo Sapiens; identical to SEQ ID NO: 154274

SEQ ID NO: 760421 - RNA, 64 nt, Homo Sapiens; identical to SEQ ID NO: 154275

SEQ ID NO: 760422 - RNA, 64 nt, Homo Sapiens; identical to SEQ ID NO: 154276

SEQ ID NO: 760423 - RNA, 64 nt, Homo Sapiens; identical to SEQ ID NO: 154277

SEQ ID NO: 760424 - RNA, 64 nt, Homo Sapiens; identical to SEQ ID NO: 154278

SEQ ID NO: 760425 - RNA, 64 nt, Homo Sapiens; identical to SEQ ID NO: 99218

SEQ ID NO: 760426 - RNA, 64 nt, Homo Sapiens; identical to SEQ ID NO: 99219

SEQ ID NO: 760427 - RNA, 64 nt, Homo Sapiens; identical to SEQ ID NO: 99220

SEQ ID NO: 760428 - RNA, 64 nt, Homo Sapiens; identical to SEQ ID NO: 99221

SEQ ID NO: 760429 - RNA, 64 nt, Homo Sapiens; identical to SEQ ID NO: 99222

SEQ ID NO: 760430 - RNA, 64 nt, Homo Sapiens; identical to SEQ ID NO: 99223

SEQ ID NO: 760431 - RNA, 64 nt, Homo Sapiens; identical to SEQ ID NO: 99224

SEQ ID NO: 760432 - RNA, 64 nt, Homo Sapiens; identical to SEQ ID NO: 99225

SEQ ID NO: 760433 - RNA, 64 nt, Homo Sapiens; identical to SEQ ID NO: 99226

SEQ ID NO: 760434 - RNA, 64 nt, Homo Sapiens; identical to SEQ ID NO: 99227

SEQ ID NO: 760435 - RNA, 64 nt, Homo Sapiens; identical to SEQ ID NO: 99228

SEQ ID NO: 760436 - RNA, 64 nt, Homo Sapiens; identical to SEQ ID NO: 99229

SEQ ID NO: 760437 - RNA, 64 nt, Homo Sapiens; identical to SEQ ID NO: 99230

SEQ ID NO: 760438 - RNA, 64 nt, Homo Sapiens; identical to SEQ ID NO: 99231

SEQ ID NO: 760439 - RNA, 64 nt, Homo Sapiens; identical to SEQ ID NO: 99232

SEQ ID NO: 760440 - RNA, 64 nt, Homo Sapiens; identical to SEQ ID NO: 99233

SEQ ID NO: 760441 - RNA, 64 nt, Homo Sapiens; identical to SEQ ID NO: 99234

SEQ ID NO: 760442 - RNA, 64 nt, Homo Sapiens; identical to SEQ ID NO: 99235

SEQ ID NO: 760443 - RNA, 64 nt, Homo Sapiens; identical to SEQ ID NO: 99236

SEQ ID NO: 760444 - RNA, 64 nt, Homo Sapiens; identical to SEQ ID NO: 99237

SEQ ID NO: 760445 - RNA, 64 nt, Homo Sapiens; identical to SEQ ID NO: 99238

SEQ ID NO: 760446 - RNA, 64 nt, Homo Sapiens; identical to SEQ ID NO: 99239

SEQ ID NO: 760447 - RNA, 64 nt, Homo Sapiens; identical to SEQ ID NO: 99240

SEQ ID NO: 760448 - RNA, 64 nt, Homo Sapiens; identical to SEQ ID NO: 99241

SEQ ID NO: 760449 - RNA, 64 nt, Homo Sapiens; identical to SEQ ID NO: 534582

SEQ ID NO: 760450 - RNA, 64 nt, Homo Sapiens; identical to SEQ ID NO: 534583

SEQ ID NO: 760451 - RNA, 64 nt, Homo Sapiens; identical to SEQ ID NO: 534584

SEQ ID NO: 760452 - RNA, 64 nt, Homo Sapiens; identical to SEQ ID NO: 534585

SEQ ID NO: 760453 - RNA, 64 nt, Homo Sapiens; identical to SEQ ID NO: 534586

SEQ ID NO: 760454 - RNA, 64 nt, Homo Sapiens; identical to SEQ ID NO: 534587

SEQ ID NO: 760455 - RNA, 64 nt, Homo Sapiens; identical to SEQ ID NO: 534588

SEQ ID NO: 760456 - RNA, 64 nt, Homo Sapiens; identical to SEQ ID NO: 534589

SEQ ID NO: 760457 - RNA, 64 nt, Homo Sapiens; identical to SEQ ID NO: 534590

SEQ ID NO: 760458 - RNA, 64 nt, Homo Sapiens; identical to SEQ ID NO: 534591

SEQ ID NO: 760459 - RNA, 64 nt, Homo Sapiens; identical to SEQ ID NO: 534592

SEQ ID NO: 760460 - RNA, 64 nt, Homo Sapiens; identical to SEQ ID NO: 534593

SEQ ID NO: 760461 - RNA, 64 nt, Homo Sapiens; identical to SEQ ID NO: 534594

SEQ ID NO: 760462 - RNA, 64 nt, Homo Sapiens; identical to SEQ ID NO: 534595

SEQ ID NO: 760463 - RNA, 64 nt, Homo Sapiens; identical to SEQ ID NO: 534596

SEQ ID NO: 760464 - RNA, 64 nt, Homo Sapiens
cauguucauuugauucauaaaaaugaggacaaaucaccuuaaaagacuuaccccagcuaccguu

SEQ ID NO: 760465 - RNA, 64 nt, Homo Sapiens
aucuuucaauuccauacuucguauaugauguagucaccuuaacuuuucaaacuauguuuuacuu

SEQ ID NO: 760466 - RNA, 64 nt, Homo Sapiens
uuuuggaugccauuugauuguaauaaaacuguggcaccuuaauuuugaauggcagcaugaucau

SEQ ID NO: 760467 - RNA, 64 nt, Homo Sapiens
gaaauauuuaggauaaacaaaauucuauuuaauccaccuuaaaaccuaaauguauuuucaugga

SEQ ID NO: 760468 - RNA, 64 nt, Homo Sapiens
caccagugaaaggcuuugagaaggacgugggcagcaaaacgacacugcgcaucaccuaccccga

SEQ ID NO: 760469 - RNA, 64 nt, Homo Sapiens
gauaaguuggauucuuucagagcauucuuuuccucaaaacgagcugcauaauucuuggaauuua

SEQ ID NO: 760470 - RNA, 64 nt, Homo Sapiens
ccgagaucgcaccacugcacuccagccuaggagacaaaacgagacuucauuuaaaaaaaauaaa

SEQ ID NO: 760471 - RNA, 64 nt, Homo Sapiens
cuucuuaucuggaugaaggcuuuuggaggagaaccaaaacgacaaguuccaagaagaagaugaa

SEQ ID NO: 760472 - RNA, 64 nt, Homo Sapiens
aagaaaccauuaauguuuaauuuaaucuuaauaccaaaacgaccagauugaaguuugacuuuua

SEQ ID NO: 760473 - RNA, 64 nt, Homo Sapiens
agccugggcaacagagcaagacugucucaaaaaacaaaacgaaacaaaaaaagaaaguuauucu

SEQ ID NO: 760474 - RNA, 64 nt, Homo Sapiens
cuugucaggagcaccuccuaggaauaaauguuugcaaaacgaaccugcugguggguuagaucaa

SEQ ID NO: 760475 - RNA, 64 nt, Homo Sapiens
uauuugccuuaggucagauucuacuaguuuaaagcaaaacgaucuccuggucugauuccuuugg

SEQ ID NO: 760476 - RNA, 64 nt, Homo Sapiens
uugaaagggaaaaaagacaaaaagcauaaggcuccaaaacgaaagcaagcauuucacuggcagc

SEQ ID NO: 760477 - RNA, 64 nt, Homo Sapiens
ucauauaauaaggugaugucggaaacacgcaaaacaaaacgaaaaaagauuucucaguauacac

SEQ ID NO: 760478 - RNA, 50 nt, Homo Sapiens
gagucuaagcauugccacuucaaaacgaaaacgcggucgccccuuuguaa

SEQ ID NO: 760479 - RNA, 64 nt, Homo Sapiens
cuccaggucggcacuuuccacuucuguacgguggcaaaacgaugacauguaaccuugcuguuua

SEQ ID NO: 760480 - RNA, 64 nt, Homo Sapiens
aagcuccuuuguauaucuugguaauuuauauuuucaaaacgaaguucuuacuuuuaaagagaau

SEQ ID NO: 760481 - RNA, 64 nt, Homo Sapiens
uugggaguuuaaauuacuucaggggaagagaagacaaaacgagucuuucauucggugugaacuu

SEQ ID NO: 760482 - RNA, 64 nt, Homo Sapiens
gggaauaaaucaugacuuaucccauuuucaauaacaaaacgaaacuauggcacuaaccaaaaac

SEQ ID NO: 760483 - RNA, 64 nt, Homo Sapiens
cagaagagugagaagcagauuccaccaugaggugcaaaacgagacuggacguguuuagauaguu

SEQ ID NO: 760484 - RNA, 64 nt, Homo Sapiens
gagcuguaaccccuucacucugucacuguagaugcaaaacgaauuguauugagugccuauucau

SEQ ID NO: 760485 - RNA, 64 nt, Homo Sapiens
ugauggaaaugcucuugagcucuucauagcacaacaaaacgaaacauuuuuuccugaucuguca

SEQ ID NO: 760486 - RNA, 64 nt, Homo Sapiens
gugcuucucaucaaugauaucaaccuuuaaaaaacaaaacgaaacuaagggccauccaaccauc

SEQ ID NO: 760487 - RNA, 64 nt, Homo Sapiens
uuauuaagaggcuauaugcaucuuuuugguuugucaaaacgagggcauuacaaaaauuuagcua

SEQ ID NO: 760488 - RNA, 64 nt, Homo Sapiens
ugaagauucaagucaguuguucaguuacuugaagcaaaacgaaaucuuucauuucagucaaauc

SEQ ID NO: 760489 - RNA, 64 nt, Homo Sapiens
aaccucugagccuugguguacagaccaccuuucacaaaacgaaaugcuaugacuguaucuugau

SEQ ID NO: 760490 - RNA, 50 nt, Homo Sapiens
gagauucucugagugccugacaaaacgaauuuaaguaccagccaaguaca

SEQ ID NO: 760491 - RNA, 64 nt, Homo Sapiens
acgugccuccauaaccugaacugugccgacuccacaaaacgauuauguacucuucugagauaga

SEQ ID NO: 760492 - RNA, 64 nt, Homo Sapiens
aaguuaugcugucauggucccccacccaccucaccaaaacgauguggggaaggcuuuguauaau

SEQ ID NO: 760493 - RNA, 64 nt, Homo Sapiens
acagugcugacccggcacagcgcuaugccccggacaaaacgagcuggacccugcguuugccgag

SEQ ID NO: 760494 - RNA, 64 nt, Homo Sapiens
ucgcaaauuuuccaaucucccacucacguuuuuacaaaacgaaugcucuaaauucugaggauuc

SEQ ID NO: 760495 - RNA, 64 nt, Homo Sapiens
uacacacagaaaaaagucuucacagacaaaaaaacaaaacgaaacuccccuaugcucaugccca

SEQ ID NO: 760496 - RNA, 64 nt, Homo Sapiens
acaaaucucgaguguguugcaaacacaaaaaagccaaaacgaaagaaaaaaggaaaaaaaauca

SEQ ID NO: 760497 - RNA, 64 nt, Homo Sapiens
aguguaccguaaauguuguguuuucagaaaaagacaaaacgauggugcugacugguuuucugua

SEQ ID NO: 760498 - RNA, 64 nt, Homo Sapiens
ggaagaggaugauuccuaacugcucagccaaaaccaaaacgaggagugaaagcuccugugguuu

SEQ ID NO: 760499 - RNA, 64 nt, Homo Sapiens
aguaagaugugaaauucacaaaaaguaaaccaaacaaaacgaaugaaaaacuggaaauaauucg

SEQ ID NO: 760500 - RNA, 64 nt, Homo Sapiens
aauuuaugaugcugugacaagaaauuuaaagaaucaaaacgaugguuugaaaaggaaaccuaug

SEQ ID NO: 760501 - RNA, 64 nt, Homo Sapiens
uauuauauguuacaauaagccuccauuagucccucaaaacgaugauauaaauaagucuguacaa

SEQ ID NO: 760502 - RNA, 64 nt, Homo Sapiens
acaucuacaccaguaaaguguaauaggucaguuucaaaacgaccaaaagacccaccacuguauu

SEQ ID NO: 760503 - RNA, 64 nt, Homo Sapiens
ggaucauucugaacauacuguguuuguuuuuaaacaaaacgaugcuguguauacauggauauuu

SEQ ID NO: 760504 - RNA, 64 nt, Homo Sapiens
cuuuuaaaagagaaaaauuauuucagugauuugucaaaacgaauuaccucuuuuggcaugagcu

SEQ ID NO: 760505 - RNA, 64 nt, Homo Sapiens
cuaaaaggaaaauuaguauuuuggauagauuugucaaaacgacauuuaagucauguuuaaaaag

SEQ ID NO: 760506 - RNA, 64 nt, Homo Sapiens
uuggaaccucaaugggggcuguucccgucuucagcaaaacgaccgucgcuuugguguugguuuc

SEQ ID NO: 760507 - RNA, 64 nt, Homo Sapiens
uuguuucccugaaccucagaccugccccucguugcaaaacgagcaggaauagcagaacauuucu

SEQ ID NO: 760508 - RNA, 64 nt, Homo Sapiens
aauaaugguuuccaaagaguauuuuuuaaaggaacaaaacgagcaugaauuaacucuucaauau

SEQ ID NO: 760509 - RNA, 64 nt, Homo Sapiens
gccucugaaggacccuucaguauuugagacauuccaaaacgaaguagguggagguggggcaugg

SEQ ID NO: 760510 - RNA, 64 nt, Homo Sapiens
guggauuuaucuaaauggaguaagcagcccaacacaaaacgagugucaagccgagcaaccugua

SEQ ID NO: 760511 - RNA, 64 nt, Homo Sapiens
gaggauuuuauugggggaagagaauaaaauaaagcaaaacgaggauaauaaggcuuauuuucac

SEQ ID NO: 760512 - RNA, 64 nt, Homo Sapiens
ccagcccgaggcacugcuacaacccacuugcuuccaaaacgaugcguggcaacacacuucacug

SEQ ID NO: 760513 - RNA, 64 nt, Homo Sapiens
uggaauuuacuacuguugucgucucugauuuccucaaaacgaaguuuguuauuuguauuugcua

SEQ ID NO: 760514 - RNA, 64 nt, Homo Sapiens
aaagcguuuucuuugcucgaggggacaaaaaagucaaaacgaggcgagaggcgaagcccacuuu

SEQ ID NO: 760515 - RNA, 64 nt, Homo Sapiens
accuuuaagagaauguagagaucuccagugaaaacaaaacgaaaaguucacuuggaggcuaaaa

SEQ ID NO: 760516 - RNA, 64 nt, Homo Sapiens
gcugauggaggaaaaaggucaguuuucuccauaucaaaacgaggaaugcaguccugaggagagg

SEQ ID NO: 760517 - RNA, 64 nt, Homo Sapiens
acaguccuaccucaguucaauacuggcuuacacucaaaacgaccaagugguaaaaucugguauu

SEQ ID NO: 760518 - RNA, 64 nt, Homo Sapiens
gacagguuguagacacacccuccccuaacaaaaacaaaacgaaagaguucauacucugauuuuc

SEQ ID NO: 760519 - RNA, 64 nt, Homo Sapiens
auugccgugacagguuuccacaaacuucguggaucaaaacgaggucuuccaguucugcggguca

SEQ ID NO: 760520 - RNA, 64 nt, Homo Sapiens
caucuugacauccccuauccgagugcauuuaucccaaaacgaggcuccugcuuuucagaggccc

SEQ ID NO: 760521 - RNA, 64 nt, Homo Sapiens
ucugguugggguacuacgaugagaaauuagaaaacaaaacgaacccagaggauggacuaagugg

SEQ ID NO: 760522 - RNA, 64 nt, Homo Sapiens
guggcaggucucaaucuugggagaaaaccauggccaaaacgauuccauauuucacuggugguug

SEQ ID NO: 760523 - RNA, 64 nt, Homo Sapiens
aaaauagagauuucacaucugcccagaccccacucaaaacgauuuggucagguucugguuggac

SEQ ID NO: 760524 - RNA, 64 nt, Homo Sapiens
aaagucagaaggcugucaaacuugcgcaacuucucaaaacgaugaaggcaauuccuauugcuuc

SEQ ID NO: 760525 - RNA, 64 nt, Homo Sapiens
uacauuuuguuuuuccauuuaauuuaauaaucaacaaaacgacaaagucaguuuaauaucuuuc

SEQ ID NO: 760526 - RNA, 64 nt, Homo Sapiens
acaguaaaaccaacaucaggccagccuguguauucaaaacgaaacaaaucucacugcuccugac

SEQ ID NO: 760527 - RNA, 64 nt, Homo Sapiens
gcugaaccuauaagcagcagaaagaaucugcuuucaaaacgaaaacccaauagaaucacucgaa

SEQ ID NO: 760528 - RNA, 64 nt, Homo Sapiens
gccuuucuuuucuuguuuaugaucucacaaaguacaaaacgaauuuucucuccaggugcagcca

SEQ ID NO: 760529 - RNA, 64 nt, Homo Sapiens
ccugcuucuuuggguugccaaucaagaguauccucaaaacgacuugacuuuaauuuucucggag

SEQ ID NO: 760530 - RNA, 64 nt, Homo Sapiens
caaagagaccagccucccucccugugccagaccucaaaacgacgggggcaggugcaaguucaua

SEQ ID NO: 760531 - RNA, 64 nt, Homo Sapiens
guguagguaagacaauaaugaaguccugaaaauccaaaacgauacuugaaagauccagaacaaa

SEQ ID NO: 760532 - RNA, 64 nt, Homo Sapiens
gggucagcccaagauucuucguuucccuccucugcaaaacgagggggugguucucugggccuca

SEQ ID NO: 760533 - RNA, 64 nt, Homo Sapiens
ucagagagaauacacguggcuauaacaucuauaacaaaacgacgauuccucuacaagaggcugu

SEQ ID NO: 760534 - RNA, 64 nt, Homo Sapiens
ccacagauccauuuuuagggaagggauuuuggcucaaaacgaucugaccaccucugcccugucc

SEQ ID NO: 760535 - RNA, 64 nt, Homo Sapiens
uaagcaaguguuagaauugcucucuucucuguuacaaaacgagaguggccaaggcugagagcuc

SEQ ID NO: 760536 - RNA, 64 nt, Homo Sapiens
ugagagagcugauuuacaucuaguccaagugaagcaaaacgaacuguugaucuguguuuuagaa

SEQ ID NO: 760537 - RNA, 64 nt, Homo Sapiens
acagcuucaaaauaugcagcaaaaaccaauacaacaaaacgaguggcacgauuuauuucaaacu

SEQ ID NO: 760538 - RNA, 64 nt, Homo Sapiens
cacgcacacacacauauggggaccugcacaccugcaaaacgagggaacaacuaagguggcugaa

SEQ ID NO: 760539 - RNA, 64 nt, Homo Sapiens
gaauguuuugcuuggaagaauaauucauugucaacaaaacgauauguucuaaacaauuucaauu

SEQ ID NO: 760540 - RNA, 64 nt, Homo Sapiens
gcaugccgggccagcuccuuugggugagggcuggcaaaacgaagaaaaacaucugaagauggau

SEQ ID NO: 760541 - RNA, 64 nt, Homo Sapiens; identical to SEQ ID NO: 137985

SEQ ID NO: 760542 - RNA, 64 nt, Homo Sapiens; identical to SEQ ID NO: 137986

SEQ ID NO: 760543 - RNA, 64 nt, Homo Sapiens; identical to SEQ ID NO: 137987

SEQ ID NO: 760544 - RNA, 64 nt, Homo Sapiens; identical to SEQ ID NO: 137988

SEQ ID NO: 760545 - RNA, 64 nt, Homo Sapiens; identical to SEQ ID NO: 137989

SEQ ID NO: 760546 - RNA, 64 nt, Homo Sapiens; identical to SEQ ID NO: 137990

SEQ ID NO: 760547 - RNA, 64 nt, Homo Sapiens; identical to SEQ ID NO: 137991

SEQ ID NO: 760548 - RNA, 64 nt, Homo Sapiens; identical to SEQ ID NO: 137992

SEQ ID NO: 760549 - RNA, 64 nt, Homo Sapiens; identical to SEQ ID NO: 137993

SEQ ID NO: 760550 - RNA, 64 nt, Homo Sapiens; identical to SEQ ID NO: 137994

SEQ ID NO: 760551 - RNA, 64 nt, Homo Sapiens; identical to SEQ ID NO: 137995

SEQ ID NO: 760552 - RNA, 64 nt, Homo Sapiens; identical to SEQ ID NO: 137996

SEQ ID NO: 760553 - RNA, 64 nt, Homo Sapiens; identical to SEQ ID NO: 137997

SEQ ID NO: 760554 - RNA, 64 nt, Homo Sapiens; identical to SEQ ID NO: 137998

SEQ ID NO: 760555 - RNA, 64 nt, Homo Sapiens; identical to SEQ ID NO: 137999

SEQ ID NO: 760556 - RNA, 64 nt, Homo Sapiens; identical to SEQ ID NO: 138000

SEQ ID NO: 760557 - RNA, 64 nt, Homo Sapiens; identical to SEQ ID NO: 138001

SEQ ID NO: 760558 - RNA, 64 nt, Homo Sapiens; identical to SEQ ID NO: 138002

SEQ ID NO: 760559 - RNA, 64 nt, Homo Sapiens; identical to SEQ ID NO: 138003

SEQ ID NO: 760560 - RNA, 64 nt, Homo Sapiens; identical to SEQ ID NO: 138004

SEQ ID NO: 760561 - RNA, 64 nt, Homo Sapiens; identical to SEQ ID NO: 138005

SEQ ID NO: 760562 - RNA, 64 nt, Homo Sapiens; identical to SEQ ID NO: 138006

SEQ ID NO: 760563 - RNA, 64 nt, Homo Sapiens; identical to SEQ ID NO: 138007

SEQ ID NO: 760564 - RNA, 64 nt, Homo Sapiens; identical to SEQ ID NO: 138008

SEQ ID NO: 760565 - RNA, 64 nt, Homo Sapiens; identical to SEQ ID NO: 138009

SEQ ID NO: 760566 - RNA, 64 nt, Homo Sapiens; identical to SEQ ID NO: 138010

SEQ ID NO: 760567 - RNA, 64 nt, Homo Sapiens; identical to SEQ ID NO: 572067

SEQ ID NO: 760568 - RNA, 64 nt, Homo Sapiens; identical to SEQ ID NO: 572068

SEQ ID NO: 760569 - RNA, 64 nt, Homo Sapiens; identical to SEQ ID NO: 572069

SEQ ID NO: 760570 - RNA, 64 nt, Homo Sapiens; identical to SEQ ID NO: 572070

SEQ ID NO: 760571 - RNA, 64 nt, Homo Sapiens; identical to SEQ ID NO: 572071

SEQ ID NO: 760572 - RNA, 64 nt, Homo Sapiens; identical to SEQ ID NO: 572072

SEQ ID NO: 760573 - RNA, 62 nt, Homo Sapiens; identical to SEQ ID NO: 443387

SEQ ID NO: 760574 - RNA, 62 nt, Homo Sapiens; identical to SEQ ID NO: 443388

SEQ ID NO: 760575 - RNA, 62 nt, Homo Sapiens; identical to SEQ ID NO: 443389

SEQ ID NO: 760576 - RNA, 62 nt, Homo Sapiens; identical to SEQ ID NO: 443390

SEQ ID NO: 760577 - RNA, 62 nt, Homo Sapiens; identical to SEQ ID NO: 443391

SEQ ID NO: 760578 - RNA, 62 nt, Homo Sapiens; identical to SEQ ID NO: 443392

SEQ ID NO: 760579 - RNA, 62 nt, Homo Sapiens; identical to SEQ ID NO: 443393

SEQ ID NO: 760580 - RNA, 62 nt, Homo Sapiens; identical to SEQ ID NO: 443394

SEQ ID NO: 760581 - RNA, 62 nt, Homo Sapiens; identical to SEQ ID NO: 443395

SEQ ID NO: 760582 - RNA, 62 nt, Homo Sapiens; identical to SEQ ID NO: 443396

SEQ ID NO: 760583 - RNA, 62 nt, Homo Sapiens; identical to SEQ ID NO: 443397

SEQ ID NO: 760584 - RNA, 62 nt, Homo Sapiens; identical to SEQ ID NO: 443398

SEQ ID NO: 760585 - RNA, 62 nt, Homo Sapiens; identical to SEQ ID NO: 443399

SEQ ID NO: 760586 - RNA, 62 nt, Homo Sapiens; identical to SEQ ID NO: 443400

SEQ ID NO: 760587 - RNA, 62 nt, Homo Sapiens; identical to SEQ ID NO: 443401

SEQ ID NO: 760588 - RNA, 62 nt, Homo Sapiens; identical to SEQ ID NO: 443402

SEQ ID NO: 760589 - RNA, 62 nt, Homo Sapiens; identical to SEQ ID NO: 443403

SEQ ID NO: 760590 - RNA, 62 nt, Homo Sapiens; identical to SEQ ID NO: 443404

SEQ ID NO: 760591 - RNA, 62 nt, Homo Sapiens; identical to SEQ ID NO: 443405

SEQ ID NO: 760592 - RNA, 62 nt, Homo Sapiens; identical to SEQ ID NO: 443406

SEQ ID NO: 760593 - RNA, 62 nt, Homo Sapiens; identical to SEQ ID NO: 443407

SEQ ID NO: 760594 - RNA, 62 nt, Homo Sapiens; identical to SEQ ID NO: 443408

SEQ ID NO: 760595 - RNA, 64 nt, Homo Sapiens; identical to SEQ ID NO: 443409

SEQ ID NO: 760596 - RNA, 64 nt, Homo Sapiens; identical to SEQ ID NO: 443410

SEQ ID NO: 760597 - RNA, 64 nt, Homo Sapiens; identical to SEQ ID NO: 443411

SEQ ID NO: 760598 - RNA, 64 nt, Homo Sapiens; identical to SEQ ID NO: 443412

SEQ ID NO: 760599 - RNA, 64 nt, Homo Sapiens; identical to SEQ ID NO: 443413

SEQ ID NO: 760600 - RNA, 64 nt, Homo Sapiens; identical to SEQ ID NO: 443414

SEQ ID NO: 760601 - RNA, 64 nt, Homo Sapiens; identical to SEQ ID NO: 443415

SEQ ID NO: 760602 - RNA, 64 nt, Homo Sapiens; identical to SEQ ID NO: 443416

SEQ ID NO: 760603 - RNA, 64 nt, Homo Sapiens; identical to SEQ ID NO: 443417

SEQ ID NO: 760604 - RNA, 64 nt, Homo Sapiens; identical to SEQ ID NO: 443418

SEQ ID NO: 760605 - RNA, 64 nt, Homo Sapiens; identical to SEQ ID NO: 443419

SEQ ID NO: 760606 - RNA, 64 nt, Homo Sapiens; identical to SEQ ID NO: 443420

SEQ ID NO: 760607 - RNA, 64 nt, Homo Sapiens; identical to SEQ ID NO: 443421

SEQ ID NO: 760608 - RNA, 64 nt, Homo Sapiens; identical to SEQ ID NO: 443422

SEQ ID NO: 760609 - RNA, 64 nt, Homo Sapiens; identical to SEQ ID NO: 443423

SEQ ID NO: 760610 - RNA, 64 nt, Homo Sapiens; identical to SEQ ID NO: 443424

SEQ ID NO: 760611 - RNA, 64 nt, Homo Sapiens; identical to SEQ ID NO: 443425

SEQ ID NO: 760612 - RNA, 64 nt, Homo Sapiens; identical to SEQ ID NO: 443426

SEQ ID NO: 760613 - RNA, 64 nt, Homo Sapiens; identical to SEQ ID NO: 443427

SEQ ID NO: 760614 - RNA, 64 nt, Homo Sapiens; identical to SEQ ID NO: 443428

SEQ ID NO: 760615 - RNA, 64 nt, Homo Sapiens; identical to SEQ ID NO: 443429

SEQ ID NO: 760616 - RNA, 64 nt, Homo Sapiens; identical to SEQ ID NO: 443430

SEQ ID NO: 760617 - DNA, 22 bp, Artificial Sequence
  Synthetic
actctaaagagaagcgctttgt

SEQ ID NO: 760618 - DNA, 22 bp, Artificial Sequence
  Synthetic
acccaccaaagagaagcacttt

SEQ ID NO: 760619 - DNA, 21 bp, Artificial Sequence
  Synthetic
gtccctgtactggaacttgag

SEQ ID NO: 760620 - DNA, 21 bp, Artificial Sequence
  Synthetic
gtgtccctgtactggaacgca

SEQ ID NO: 760621 - DNA, 20 bp, Artificial Sequence
  Synthetic
gcctggccatgtcagctacg

SEQ ID NO: 760622 - DNA, 21 bp, Artificial Sequence
  Synthetic
ttgatgggaggctagtgtttc

SEQ ID NO: 760623 - DNA, 21 bp, Artificial Sequence
  Synthetic
gacgtggaggcgttcttagtc

SEQ ID NO: 760624 - DNA, 20 bp, Artificial Sequence
  Synthetic
tgacaaccgttggggattac

SEQ ID NO: 760625 - DNA, 85 bp, Homo Sapiens
gctcaggctgtgatttcaagccagggggcgtttttctataactggatgaaaagcacctccagagcttgaagctcacagtttgaga

SEQ ID NO: 760626 - DNA, 87 bp, Homo Sapiens
tctcctgctgtgaccctcaagatggaagcagtttctgttgtctgaaaggaaagaaagtgcttcctttttgagggttactgtttgaga

SEQ ID NO: 760627 - DNA, 83 bp, Homo Sapiens
tctcatgcagtcattctccaaaagaaagcactttctgttgtctgaaagcagagtgccttcttttggagcgttactgtttgaga

SEQ ID NO: 760628 - DNA, 84 bp, Homo Sapiens
tctcatgcagtcattctccaaaagggagcactttctgtttgaaagaaaacaaagtgcctccttttagagtgttactgtttgaga

SEQ ID NO: 760629 - DNA, 87 bp, Homo Sapiens
tctcaggctgtgaccctctaaagggaagcgctttctgtggtcagaaagaaaagcaagtgcttccttttagagggttaccgtttggga

SEQ ID NO: 760630 - DNA, 83 bp, Homo Sapiens; identical to SEQ ID NO: 760627

SEQ ID NO: 760631 - DNA, 87 bp, Homo Sapiens
tctcagcctgtgaccctctagagggaagcgctttctgttgtctgaaagaaaagaaagtgcatctttttagaggattacagtttgaga

SEQ ID NO: 760632 - DNA, 87 bp, Homo Sapiens
tctcaagctatgagtctacaaaggaaagcgctttctgttgtcagaaagaagagaaagcgcttcccttttgagggttacggtttgaga

SEQ ID NO: 760633 - DNA, 85 bp, Homo Sapiens
ctcaggctgtgaccctccagagggaagtactttctgttgtctgagagaaaagaaagtgcttccctttggactgtttcggtttgag

SEQ ID NO: 760634 - DNA, 81 bp, Homo Sapiens
caggctgtgaccctcttgagggaagcactttctgttgtctgaaagaagagaaagtgcttccttttagaggcttactgtctg

SEQ ID NO: 760635 - DNA, 67 bp, Homo Sapiens
tgaccctctagagggaagcgctttctgttgtctgaaagaaaagaaagtgcatccttttagaggttta

SEQ ID NO: 760636 - DNA, 85 bp, Homo Sapiens
ctcaagctgtgactctccagagggatgcactttctcttatgtgaaaaaaaagaaggcgcttccctttagagcgttacggtttggg

SEQ ID NO: 760637 - DNA, 87 bp, Homo Sapiens
tctcatgctgtgaccctctagagggaagcgctttctgttgtctgaaagaaaagaacgcgcttccctatagagggttaccctttgaga

SEQ ID NO: 760638 - DNA, 87 bp, Homo Sapiens
tctcatgctgtgaccctctagagggaagcactttctcttgtctaaaagaaaagaaagcgcttctctttagaggattactctttgaga

SEQ ID NO: 760639 - DNA, 61 bp, Homo Sapiens
ccctctacagggaagcgctttctgttgtctgaaagaaaagaaagtgcttccttttagaggg

SEQ ID NO: 760640 - DNA, 83 bp, Homo Sapiens
tcatgctgtggccctccagagggaagcgctttctgttgtctgaaagaaaacaaagcgctcccctttagaggtttacggtttga

SEQ ID NO: 760641 - DNA, 85 bp, Homo Sapiens
ctcaggctgtgaccctctagagggaagcactttctgttgcttgaaagaagagaaagcgcttccttttagaggattactctttgag

SEQ ID NO: 760642 - DNA, 87 bp, Homo Sapiens
tctcaggctgtcgtcctctagagggaagcactttctgttgtctgaaagaaaagaaagtgcttccttttagagggttaccgtttgaga

SEQ ID NO: 760643 - DNA, 87 bp, Homo Sapiens
tctcatgctgtgactctctggagggaagcactttctgttgtctgaaagaaaacaaagcgcttctctttagagtgttacggtttgaga

SEQ ID NO: 760644 - DNA, 87 bp, Homo Sapiens
tctcatgctgtgaccctacaaagggaagcactttctcttgtccaaaggaaaagaaggcgcttccctttggagtgttacggtttgaga

SEQ ID NO: 760645 - DNA, 87 bp, Homo Sapiens
tctcaggcagtgaccctctagatggaagcactgtctgttgtataaaagaaaagatcgtgcatccctttagagtgttactgtttgaga

SEQ ID NO: 760646 - DNA, 88 bp, Homo Sapiens
tcccatgctgtgaccctccaaagggaagcgctttctgtttgttttctcttaaacaaagtgcctccctttagagtgttaccgtttggga

SEQ ID NO: 760647 - DNA, 87 bp, Homo Sapiens
tctcgggctgtgactctccaaagggaagaattttctcttgtctaaaagaaaagaacgcacttccctttagagtgttaccgtgtgaga

SEQ ID NO: 760648 - DNA, 87 bp, Homo Sapiens
tctcaagctgtgagtctacaaagggaagccctttctgttgtctaaaagaaaagaaagtgcttctctttggtgggttacggtttgaga

SEQ ID NO: 760649 - DNA, 67 bp, Homo Sapiens
gtgaccctctagatggaagcactgtctgttgtctaagaaaagatcgtgcatccctttagagtgttac

SEQ ID NO: 760650 - DNA, 90 bp, Homo Sapiens
tcccatgctgtgaccctctagaggaagcactttctgtttgttgtctgagaaaaaacaaagtgcttccctttagagtgttaccgtttggga

SEQ ID NO: 760651 - DNA, 85 bp, Homo Sapiens
tctcatgatgtgaccatctggaggtaagaagcactttgtgttttgtgaaagaaagtgcttcctttcagagggttactctttgaga

SEQ ID NO: 760652 - DNA, 83 bp, Homo Sapiens
tctcgtgctgtgaccctctagagggaagcactttctgttgaaagaaaagaacatgcatcctttcagagggttactctttgaga

SEQ ID NO: 760653 - DNA, 88 bp, Homo Sapiens
tctcaggctgtgaccctctagagggaagcgctttctgttggctaaaagaaaagaaagcgcttcccttcagagtgttaacgctttgaga

SEQ ID NO: 760654 - DNA, 85 bp, Homo Sapiens
tctcaagctgtgactgcaaagggaagccctttctgttgtctgaaagaagagaaagcgcttccctttgctggattacggtttgaga

SEQ ID NO: 760655 - DNA, 87 bp, Homo Sapiens
tcccatgctgtgaccctctagagggaagcactttctgttgtctgaaagaaaccaaagcgcttccctttggagcgttacggtttgaga

SEQ ID NO: 760656 - DNA, 90 bp, Homo Sapiens
tctcaggctgtgaccatctggaggtaagaagcactttctgttttgtgaaagaaaagaaagtgcttcctttcagagggttactctttgaga

SEQ ID NO: 760657 - DNA, 87 bp, Homo Sapiens
tctcaagctgtgggtctgcaaagggaagccctttctgttgtctaaaagaagagaaagcgcttccctttgctggattacggtttgaga

SEQ ID NO: 760658 - DNA, 85 bp, Homo Sapiens
tctcaggcagtgaccctctagatggaagcactgtctgttgtctaagaaaagatcgtgcatccttttagagtgttactgtttgaga

SEQ ID NO: 760659 - DNA, 88 bp, Homo Sapiens
tcccatgctgtgaccctctagaggaagcactttctgtttgttgtctgagaaaaaacaaagtgcttccctttagagttactgtttggga

SEQ ID NO: 760660 - DNA, 87 bp, Homo Sapiens
tctcaggctgtgaccctccaaagggaagaactttctgttgtctaaaagaaaagaacgcacttccctttagagtgttaccgtgtgaga

SEQ ID NO: 760661 - DNA, 87 bp, Homo Sapiens
tctcaggctgtgtccctctagagggaagcgctttctgttgtctgaaagaaaagaaaatggttccctttagagtgttacgctttgaga

SEQ ID NO: 760662 - DNA, 85 bp, Homo Sapiens
ctcaggctgtgacactctagagggaagcgctttctgttgtctgaaagaaaggaaagtgcatccttttagagtgttactgtttgag

SEQ ID NO: 760663 - DNA, 85 bp, Homo Sapiens
tctcaagctgtgactgcaaagggaagccctttctgttgtctaaaagaaaagaaagtgcttccctttggtgaattacggtttgaga

SEQ ID NO: 760664 - DNA, 90 bp, Homo Sapiens
tctcaggctgtgaccttctcgaggaaagaagcactttctgttgtctgaaagaaaagaaagtgcttcctttcagagggttacggtttgaga

SEQ ID NO: 760665 - DNA, 87 bp, Homo Sapiens
tctcaagctgtgagtctacaaaggaaagcgctttctgttgtctgaaagaaaagaaatcgcttccctttggagtgttacggtttgaga

SEQ ID NO: 760666 - DNA, 90 bp, Homo Sapiens
tctcaggttgtgaccttctcgaggaaagaagcactttctgttgtctgaaagaaaagaaagtgcttcctttcagagggttacggtttgaga

SEQ ID NO: 760667 - DNA, 87 bp, Homo Sapiens
tctcaggctgtgtccctctacagggaagcgctttctgttgtctgaaagaaaggaaagtgcatccttttagagtgttactgtttgaga

SEQ ID NO: 760668 - DNA, 21 bp, Homo Sapiens
gtgccgccatcttttgagtgt

SEQ ID NO: 760669 - DNA, 23 bp, Homo Sapiens
aaagtgctgcgacatttgagcgt

SEQ ID NO: 760670 - DNA, 23 bp, Homo Sapiens
gaagtgcttcgattttggggtgt

SEQ ID NO: 760671 - DNA, 22 bp, Homo Sapiens
  misc_feature (12)..(12): h is a, c or t
  misc_feature (20)..(20): k is g or t
aaagtgcttcchtttagagkgt

SEQ ID NO: 760672 - DNA, 22 bp, Homo Sapiens
actcaaaatgggggcgctttcc

SEQ ID NO: 760673 - DNA, 23 bp, Homo Sapiens
taagtgcttccatgttttggtga

SEQ ID NO: 760674 - DNA, 23 bp, Homo Sapiens
taagtgcttccatgttttagtag

SEQ ID NO: 760675 - DNA, 23 bp, Homo Sapiens
taagtgcttccatgtttcagtgg

SEQ ID NO: 760676 - DNA, 23 bp, Homo Sapiens
taagtgcttccatgtttgagtgt

SEQ ID NO: 760677 - DNA, 22 bp, Homo Sapiens
  misc_feature (12)..(12): h is a, c or t
  misc_feature (20)..(20): k is g or t
aaagtgcttcchtttagagkgt

SEQ ID NO: 760678 - DNA, 19 bp, Homo sapiens
ctctagagggaagcacttt
